US012358982B2

(12) United States Patent
Loew et al.

(10) Patent No.: US 12,358,982 B2
(45) Date of Patent: Jul. 15, 2025

(54) MULTIFUNCTIONAL MOLECULES THAT BIND TO T CELL RELATED CANCER CELLS AND USES THEREOF

(71) Applicant: Marengo Therapeutics, Inc., Cambridge, MA (US)

(72) Inventors: Andreas Loew, Boston, MA (US); Nidhi Malhotra, Boston, MA (US); Madan Katragadda, Acton, MA (US); Seng-Lai Tan, Sudbury, MA (US); Jonathan Hsu, Waltham, MA (US); Brian Edward Vash, Cambridge, MA (US); Stephanie J. Maiocco, Arlington, MA (US); Peter Marek, Hudson, MA (US); Gurkan Guntas, Newton, MA (US)

(73) Assignee: Marengo Therapeutics, Inc., Cambridge, MA (US)

(*) Notice: Subject to any disclaimer, the term of this patent is extended or adjusted under 35 U.S.C. 154(b) by 901 days.

(21) Appl. No.: 17/402,325

(22) Filed: Aug. 13, 2021

(65) Prior Publication Data

US 2021/0380682 A1 Dec. 9, 2021

Related U.S. Application Data

(63) Continuation of application No. PCT/US2020/019291, filed on Feb. 21, 2020.

(60) Provisional application No. 62/808,646, filed on Feb. 21, 2019.

(51) Int. Cl.
  *A61K 39/395* (2006.01)
  *A61P 35/00* (2006.01)
  *C07K 16/28* (2006.01)
  *A61K 39/00* (2006.01)

(52) U.S. Cl.
  CPC .......... *C07K 16/28* (2013.01); *A61K 39/3955* (2013.01); *A61P 35/00* (2018.01); *C07K 16/2809* (2013.01); *C07K 16/2827* (2013.01); *A61K 2039/505* (2013.01); *C07K 2317/31* (2013.01); *C07K 2317/52* (2013.01); *C07K 2317/55* (2013.01); *C07K 2317/56* (2013.01); *C07K 2317/565* (2013.01); *C07K 2317/622* (2013.01); *C07K 2317/732* (2013.01); *C07K 2317/92* (2013.01)

(58) Field of Classification Search
  CPC .. A61K 39/3955; A61K 39/395; C07K 16/28; C07K 16/2827; C07K 16/2809
  See application file for complete search history.

(56) References Cited

U.S. PATENT DOCUMENTS

| | | |
|---|---|---|
| 861,745 A | 7/1907 | Maxwell |
| 4,433,059 A | 2/1984 | Chang et al. |
| 4,439,196 A | 3/1984 | Higuchi |
| 4,444,878 A | 4/1984 | Paulus |
| 4,447,224 A | 5/1984 | DeCant, Jr. et al. |
| 4,447,233 A | 5/1984 | Mayfield |
| 4,475,196 A | 10/1984 | La Zor |
| 4,486,194 A | 12/1984 | Ferrara |
| 4,487,603 A | 12/1984 | Harris |
| 4,522,811 A | 6/1985 | Eppstein et al. |
| 4,596,556 A | 6/1986 | Morrow et al. |
| 4,676,980 A | 6/1987 | Segal et al. |
| 4,737,456 A | 4/1988 | Weng et al. |
| 4,790,824 A | 12/1988 | Morrow et al. |
| 4,816,567 A | 3/1989 | Cabilly et al. |
| 4,941,880 A | 7/1990 | Burns |
| 5,057,423 A | 10/1991 | Hiserodt et al. |
| 5,064,413 A | 11/1991 | McKinnon et al. |
| 5,116,615 A | 5/1992 | Gokcen et al. |
| 5,208,020 A | 5/1993 | Chari et al. |
| 5,223,409 A | 6/1993 | Ladner et al. |
| 5,225,539 A | 7/1993 | Winter |
| 5,273,743 A | 12/1993 | Ahlem et al. |
| 5,312,335 A | 5/1994 | McKinnon et al. |
| 5,374,548 A | 12/1994 | Caras |
| 5,383,851 A | 1/1995 | McKinnon, Jr. et al. |
| 5,391,377 A | 2/1995 | Barnwell |
| 5,399,163 A | 3/1995 | Peterson et al. |

(Continued)

FOREIGN PATENT DOCUMENTS

| | | |
|---|---|---|
| AU | 2001278662 B2 | 9/2006 |
| CA | 3016563 A1 | 9/2017 |

(Continued)

OTHER PUBLICATIONS

Knappik et al., J. Mol. Biol., 2000, vol. 296(1):57-86.*
Nair et al., 2002, J. Immunol., vol. 168(5):2371-2382.*
Maciocia et al., Nat. Med., 2017, vol. 23:1416-1423.*
Adachi, Osamu, et al., Targeted Disruption of the MyD88 Gene Results in Loss of IL-1-and IL-8-Mediated Function. Immunity 9(1):143-150 (1998).
Agostinis, Patrizia, et al., Photodynamic Therapy of Cancer: An Update. CA: A Cancer Journal for Clinicians 61(4):250-281 (2011).
Aigner et al.: An effective tumor vaccine optimized for costimulation via bispecific and trispecific fusion proteins. Int J Oncol. 32(4):777-789 (2008).

(Continued)

*Primary Examiner* — Xiaozhen Xie
(74) *Attorney, Agent, or Firm* — Wilson Sonsoni Goodrich & Rosati

(57) ABSTRACT

Multifunctional molecules that include i) an antigen binding domain that binds to a T cell receptor beta chain constant domain 1 or T cell receptor beta chain constant domain 2; and one, two or all of: (ii) an immune cell engager (e.g., chosen from an NK cell engager, a T cell engager, a B cell engager, a dendritic cell engager, or a macrophage cell engager); (iii) a cytokine molecule or cytokine inhibitor molecule; (iv) a death receptor signal enhancer; and/or (v) a stromal modifying moiety are disclosed. Additionally disclosed are nucleic acids encoding the same, methods of producing the aforesaid molecules, and methods of treating a cancer using the aforesaid molecules.

23 Claims, 47 Drawing Sheets

Specification includes a Sequence Listing.

(56) References Cited

U.S. PATENT DOCUMENTS

| | | |
|---|---|---|
| 5,399,331 A | 3/1995 | Loughrey et al. |
| 5,416,016 A | 5/1995 | Low et al. |
| 5,416,064 A | 5/1995 | Chari et al. |
| 5,500,362 A | 3/1996 | Robinson et al. |
| 5,534,254 A | 7/1996 | Huston et al. |
| 5,571,894 A | 11/1996 | Wels et al. |
| 5,582,996 A | 12/1996 | Curtis |
| 5,585,089 A | 12/1996 | Queen et al. |
| 5,587,458 A | 12/1996 | King et al. |
| 5,591,828 A | 1/1997 | Bosslet et al. |
| 5,624,821 A | 4/1997 | Winter et al. |
| 5,626,561 A | 5/1997 | Butler et al. |
| 5,635,483 A | 6/1997 | Pettit et al. |
| 5,635,602 A | 6/1997 | Cantor et al. |
| 5,637,481 A | 6/1997 | Ledbetter et al. |
| 5,641,870 A | 6/1997 | Rinderknecht et al. |
| 5,648,237 A | 7/1997 | Carter |
| 5,648,260 A | 7/1997 | Winter et al. |
| 5,693,761 A | 12/1997 | Queen et al. |
| 5,693,762 A | 12/1997 | Queen et al. |
| 5,712,374 A | 1/1998 | Kuntsmann et al. |
| 5,714,586 A | 2/1998 | Kunstmann et al. |
| 5,731,116 A | 3/1998 | Matsuo et al. |
| 5,731,168 A | 3/1998 | Carter et al. |
| 5,739,116 A | 4/1998 | Hamann et al. |
| 5,747,036 A | 5/1998 | Brenner et al. |
| 5,750,373 A | 5/1998 | Garrard et al. |
| 5,766,947 A | 6/1998 | Rittershaus et al. |
| 5,767,285 A | 6/1998 | Hamann et al. |
| 5,770,429 A | 6/1998 | Lonberg et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,787,900 A | 8/1998 | Butler et al. |
| 5,789,199 A | 8/1998 | Joly et al. |
| 5,811,097 A | 9/1998 | Allison et al. |
| 5,821,337 A | 10/1998 | Carter et al. |
| 5,831,012 A | 11/1998 | Nilsson et al. |
| 5,837,242 A | 11/1998 | Holliger et al. |
| 5,837,821 A | 11/1998 | Wu |
| 5,840,523 A | 11/1998 | Simmons et al. |
| 5,843,069 A | 12/1998 | Butler et al. |
| 5,844,094 A | 12/1998 | Hudson et al. |
| 5,849,500 A | 12/1998 | Breitling et al. |
| 5,849,589 A | 12/1998 | Tedder et al. |
| 5,861,155 A | 1/1999 | Lin |
| 5,864,019 A | 1/1999 | King et al. |
| 5,869,046 A | 2/1999 | Presta et al. |
| 5,869,620 A | 2/1999 | Whitlow et al. |
| 5,877,296 A | 3/1999 | Hamann et al. |
| 5,902,745 A | 5/1999 | Butler et al. |
| 5,910,573 A | 6/1999 | Plueckthun et al. |
| 5,913,998 A | 6/1999 | Butler et al. |
| 5,932,448 A | 8/1999 | Tso et al. |
| 5,959,083 A | 9/1999 | Bosslet et al. |
| 5,959,177 A | 9/1999 | Hein et al. |
| 5,968,753 A | 10/1999 | Tseng-Law et al. |
| 5,980,889 A | 11/1999 | Butler et al. |
| 5,989,830 A | 11/1999 | Davis et al. |
| 6,005,079 A | 12/1999 | Casterman et al. |
| 6,040,498 A | 3/2000 | Stomp et al. |
| 6,075,181 A | 6/2000 | Kucherlapati et al. |
| 6,120,766 A | 9/2000 | Hale et al. |
| 6,150,584 A | 11/2000 | Kucherlapati et al. |
| 6,171,586 B1 | 1/2001 | Lam et al. |
| 6,172,197 B1 | 1/2001 | McCafferty et al. |
| 6,194,551 B1 | 2/2001 | Idusogie et al. |
| 6,239,259 B1 | 5/2001 | Davis et al. |
| 6,248,516 B1 | 6/2001 | Winter et al. |
| 6,267,958 B1 | 7/2001 | Andya et al. |
| 6,291,158 B1 | 9/2001 | Winter et al. |
| 6,294,353 B1 | 9/2001 | Pack et al. |
| 6,333,396 B1 | 12/2001 | Filpula et al. |
| 6,352,694 B1 | 3/2002 | June et al. |
| 6,417,429 B1 | 7/2002 | Hein et al. |
| 6,420,548 B1 | 7/2002 | Vezina et al. |
| 6,476,198 B1 | 11/2002 | Kang |
| 6,511,663 B1 | 1/2003 | King et al. |
| 6,534,055 B1 | 3/2003 | June et al. |
| 6,582,915 B1 | 6/2003 | Griffiths et al. |
| 6,593,081 B1 | 7/2003 | Griffiths et al. |
| 6,602,684 B1 | 8/2003 | Umana et al. |
| 6,630,579 B2 | 10/2003 | Chari et al. |
| 6,632,427 B1 | 10/2003 | Finiels et al. |
| 6,670,453 B2 | 12/2003 | Frenken et al. |
| 6,696,245 B2 | 2/2004 | Winter et al. |
| 6,703,199 B1 | 3/2004 | Koide |
| 6,737,056 B1 | 5/2004 | Presta |
| 6,743,896 B2 | 6/2004 | Filpula et al. |
| 6,756,523 B1 | 6/2004 | Kahn et al. |
| 6,765,087 B1 | 7/2004 | Casterman et al. |
| 6,809,185 B1 | 10/2004 | Schoonjans et al. |
| 6,818,418 B1 | 11/2004 | Lipovsek et al. |
| 6,833,441 B2 | 12/2004 | Wang et al. |
| 6,838,254 B1 | 1/2005 | Hamers et al. |
| 6,905,680 B2 | 6/2005 | June et al. |
| 6,979,546 B2 | 12/2005 | Moretta et al. |
| 6,982,321 B2 | 1/2006 | Winter |
| 7,041,870 B2 | 5/2006 | Tomizuka et al. |
| 7,083,785 B2 | 8/2006 | Browning et al. |
| 7,087,409 B2 | 8/2006 | Barbas, III et al. |
| 7,105,149 B1 | 9/2006 | Dalla-Favera |
| 7,125,978 B1 | 10/2006 | Vezina et al. |
| 7,129,330 B1 | 10/2006 | Little et al. |
| 7,183,076 B2 | 2/2007 | Arathoon et al. |
| 7,186,804 B2 | 3/2007 | Gillies et al. |
| 7,189,826 B2 | 3/2007 | Rodman |
| 7,250,297 B1 | 7/2007 | Beste et al. |
| 7,276,241 B2 | 10/2007 | Schneider et al. |
| 7,332,581 B2 | 2/2008 | Presta |
| 7,361,360 B2 | 4/2008 | Kitabwalla et al. |
| 7,371,826 B2 | 5/2008 | Presta |
| 7,402,314 B2 | 7/2008 | Sherman |
| 7,431,380 B1 | 10/2008 | Buresh |
| 7,476,724 B2 | 1/2009 | Dennis et al. |
| 7,498,298 B2 | 3/2009 | Doronina et al. |
| 7,501,121 B2 | 3/2009 | Tchistiakova et al. |
| 7,517,966 B2 | 4/2009 | Moretta et al. |
| 7,521,056 B2 | 4/2009 | Chang et al. |
| 7,521,541 B2 | 4/2009 | Eigenbrot et al. |
| 7,527,787 B2 | 5/2009 | Chang et al. |
| 7,527,791 B2 | 5/2009 | Adams et al. |
| 7,534,866 B2 | 5/2009 | Chang et al. |
| 7,563,441 B2 | 7/2009 | Graus et al. |
| 7,601,803 B1 | 10/2009 | Fiedler et al. |
| 7,612,181 B2 | 11/2009 | Wu et al. |
| 7,642,228 B2 | 1/2010 | Carter et al. |
| 7,700,739 B2 | 4/2010 | Lacy et al. |
| 7,741,446 B2 | 6/2010 | Pardridge et al. |
| 7,750,128 B2 | 7/2010 | Gegg et al. |
| 7,767,429 B2 | 8/2010 | Bookbinder et al. |
| 7,799,902 B2 | 9/2010 | Browning et al. |
| 7,803,376 B2 | 9/2010 | Velardi et al. |
| 7,807,160 B2 | 10/2010 | Presta et al. |
| 7,829,289 B2 | 11/2010 | Lantz et al. |
| 7,855,275 B2 | 12/2010 | Eigenbrot et al. |
| 7,858,759 B2 | 12/2010 | Brandt et al. |
| 7,906,118 B2 | 3/2011 | Chang et al. |
| 7,919,257 B2 | 4/2011 | Hoogenboom et al. |
| 7,943,743 B2 | 5/2011 | Korman et al. |
| 7,999,077 B2 | 8/2011 | Pastan et al. |
| 8,003,774 B2 | 8/2011 | Stavenhagen et al. |
| 8,008,449 B2 | 8/2011 | Korman et al. |
| 8,012,465 B2 | 9/2011 | Elias et al. |
| 8,034,326 B2 | 10/2011 | Hjorth et al. |
| 8,202,517 B2 | 6/2012 | Bookbinder et al. |
| 8,216,805 B2 | 7/2012 | Carter et al. |
| 8,227,577 B2 | 7/2012 | Klein et al. |
| 8,299,220 B2 | 10/2012 | Dalla-Favera |
| 8,354,509 B2 | 1/2013 | Carven et al. |
| 8,362,213 B2 | 1/2013 | Elkins et al. |
| 8,450,470 B2 | 5/2013 | Bookbinder et al. |
| 8,466,260 B2 | 6/2013 | Elkins et al. |

(56) References Cited

U.S. PATENT DOCUMENTS

| | | |
|---|---|---|
| 8,552,156 B2 | 10/2013 | Takayanagi et al. |
| 8,580,252 B2 | 11/2013 | Bookbinder et al. |
| 8,586,713 B2 | 11/2013 | Davis et al. |
| 8,592,562 B2 | 11/2013 | Kannan et al. |
| 8,609,089 B2 | 12/2013 | Langermann et al. |
| 8,617,545 B2 | 12/2013 | Hsu et al. |
| 8,617,559 B2 | 12/2013 | Elkins et al. |
| 8,658,135 B2 | 2/2014 | O'Connor-McCourt et al. |
| 8,703,132 B2 | 4/2014 | Imhof-Jung et al. |
| 8,772,246 B2 | 7/2014 | Bookbinder et al. |
| 8,790,895 B2 | 7/2014 | Fiedler et al. |
| 8,821,883 B2 | 9/2014 | Ambrose et al. |
| 8,846,042 B2 | 9/2014 | Zhou |
| 8,871,912 B2 | 10/2014 | Davis et al. |
| 8,920,776 B2 | 12/2014 | Gaiger et al. |
| 8,945,571 B2 | 2/2015 | Mössner et al. |
| 8,993,524 B2 | 3/2015 | Bedi et al. |
| 9,000,130 B2 | 4/2015 | Bhakta et al. |
| 9,034,324 B2 | 5/2015 | Kalled et al. |
| 9,056,905 B2 | 6/2015 | Olson et al. |
| 9,145,588 B2 | 9/2015 | Throsby et al. |
| 9,200,060 B2 | 12/2015 | Kannan et al. |
| 9,243,058 B2 | 1/2016 | Armitage et al. |
| 9,309,311 B2 | 4/2016 | Gurney et al. |
| 9,340,621 B2 | 5/2016 | Kufer et al. |
| 9,358,286 B2 | 6/2016 | De et al. |
| 9,359,437 B2 | 6/2016 | Davis et al. |
| 9,382,323 B2 | 7/2016 | Brinkmann et al. |
| 9,387,237 B2 | 7/2016 | Kalled et al. |
| 9,416,187 B2 | 8/2016 | Tedder et al. |
| 9,447,159 B2 | 9/2016 | Ast et al. |
| 9,447,185 B2 | 9/2016 | Romagne et al. |
| 9,545,086 B2 | 1/2017 | MacKay et al. |
| 9,593,376 B2 | 3/2017 | Zitvogel et al. |
| 9,663,577 B2 | 5/2017 | Pierres et al. |
| 9,676,863 B2 | 6/2017 | Lo |
| 9,833,476 B2 | 12/2017 | Zhang et al. |
| 10,150,816 B2 | 12/2018 | Abbot et al. |
| 10,294,300 B2 | 5/2019 | Raum et al. |
| 10,308,721 B2 | 6/2019 | Williams et al. |
| 10,478,509 B2 | 11/2019 | Torgov et al. |
| 10,610,571 B2 | 4/2020 | Ptacin et al. |
| 10,676,516 B2 | 6/2020 | Viney et al. |
| 10,730,942 B2 | 8/2020 | Pule et al. |
| 10,815,311 B2 | 10/2020 | Wesche et al. |
| 11,033,634 B2 | 6/2021 | Stull et al. |
| 11,291,721 B2 | 4/2022 | Loew et al. |
| 11,292,838 B2 | 4/2022 | Schendel et al. |
| 11,673,953 B2 | 6/2023 | Zhang et al. |
| 11,692,031 B2 | 7/2023 | Dahlhoff et al. |
| 11,845,797 B2 | 12/2023 | Tan et al. |
| 11,965,025 B2 | 4/2024 | Tan et al. |
| 12,152,073 B2 | 11/2024 | Loew et al. |
| 2002/0004587 A1 | 1/2002 | Miller et al. |
| 2002/0041865 A1 | 4/2002 | Austin et al. |
| 2002/0062010 A1 | 5/2002 | Arathoon et al. |
| 2002/0076406 A1 | 6/2002 | Leung |
| 2002/0103345 A1 | 8/2002 | Zhu |
| 2002/0164328 A1 | 11/2002 | Shinkawa et al. |
| 2003/0115614 A1 | 6/2003 | Kanda et al. |
| 2003/0130496 A1 | 7/2003 | Winter et al. |
| 2003/0157108 A1 | 8/2003 | Presta |
| 2003/0175884 A1 | 9/2003 | Umana et al. |
| 2003/0207346 A1 | 11/2003 | Arathoon et al. |
| 2003/0211078 A1 | 11/2003 | Heavner |
| 2004/0009530 A1 | 1/2004 | Wilson et al. |
| 2004/0093621 A1 | 5/2004 | Shitara et al. |
| 2004/0109865 A1 | 6/2004 | Niwa et al. |
| 2004/0110282 A1 | 6/2004 | Kanda et al. |
| 2004/0110704 A1 | 6/2004 | Yamane et al. |
| 2004/0132140 A1 | 7/2004 | Satoh et al. |
| 2004/0175756 A1 | 9/2004 | Kolkman et al. |
| 2004/0219643 A1 | 11/2004 | Winter et al. |
| 2004/0220388 A1 | 11/2004 | Mertens et al. |
| 2004/0241817 A1 | 12/2004 | Umana et al. |
| 2004/0242847 A1 | 12/2004 | Fukushima et al. |
| 2005/0003403 A1 | 1/2005 | Rossi et al. |
| 2005/0004352 A1 | 1/2005 | Kontermann et al. |
| 2005/0014934 A1 | 1/2005 | Hinton et al. |
| 2005/0048512 A1 | 3/2005 | Kolkman et al. |
| 2005/0053973 A1 | 3/2005 | Kolkman et al. |
| 2005/0069552 A1 | 3/2005 | Bleck et al. |
| 2005/0079170 A1 | 4/2005 | Le Gall et al. |
| 2005/0079574 A1 | 4/2005 | Bond |
| 2005/0090648 A1 | 4/2005 | Tsurushita et al. |
| 2005/0100543 A1 | 5/2005 | Hansen et al. |
| 2005/0119455 A1 | 6/2005 | Fuh et al. |
| 2005/0123546 A1 | 6/2005 | Umana et al. |
| 2005/0136049 A1 | 6/2005 | Ledbetter et al. |
| 2005/0136051 A1 | 6/2005 | Scallon |
| 2005/0163782 A1 | 7/2005 | Glaser et al. |
| 2005/0260186 A1 | 11/2005 | Bookbinder et al. |
| 2005/0266000 A1 | 12/2005 | Bond et al. |
| 2005/0266425 A1 | 12/2005 | Zauderer et al. |
| 2006/0008844 A1 | 1/2006 | Stemmer et al. |
| 2006/0025576 A1 | 2/2006 | Miller et al. |
| 2006/0083747 A1 | 4/2006 | Winter et al. |
| 2006/0104968 A1 | 5/2006 | Bookbinder et al. |
| 2006/0120960 A1 | 6/2006 | Deyev et al. |
| 2006/0141581 A1 | 6/2006 | Gillies et al. |
| 2006/0204493 A1 | 9/2006 | Huang et al. |
| 2006/0263367 A1 | 11/2006 | Fey et al. |
| 2007/0004909 A1 | 1/2007 | Johnson et al. |
| 2007/0036783 A1 | 2/2007 | Humeau et al. |
| 2007/0061900 A1 | 3/2007 | Murphy et al. |
| 2007/0087381 A1 | 4/2007 | Kojima |
| 2007/0105105 A1 | 5/2007 | Clelland et al. |
| 2007/0117126 A1 | 5/2007 | Sidhu et al. |
| 2007/0128150 A1 | 6/2007 | Norman |
| 2007/0141049 A1 | 6/2007 | Bredehorst et al. |
| 2007/0154901 A1 | 7/2007 | Thogersen et al. |
| 2007/0160598 A1 | 7/2007 | Dennis et al. |
| 2007/0178106 A1 | 8/2007 | Romagne |
| 2007/0184052 A1 | 8/2007 | Lin et al. |
| 2007/0231322 A1 | 10/2007 | Romagne et al. |
| 2007/0237764 A1 | 10/2007 | Birtalan et al. |
| 2007/0274985 A1 | 11/2007 | Dubel et al. |
| 2007/0292936 A1 | 12/2007 | Barthelemy et al. |
| 2008/0050370 A1 | 2/2008 | Glaser et al. |
| 2008/0063717 A1 | 3/2008 | Romagne et al. |
| 2008/0069820 A1 | 3/2008 | Fuh et al. |
| 2008/0152645 A1 | 6/2008 | Pardridge et al. |
| 2008/0171855 A1 | 7/2008 | Rossi et al. |
| 2008/0241884 A1 | 10/2008 | Shitara et al. |
| 2008/0247944 A1 | 10/2008 | Graziano et al. |
| 2008/0254512 A1 | 10/2008 | Capon |
| 2008/0260738 A1 | 10/2008 | Moore et al. |
| 2008/0299137 A1 | 12/2008 | Svendsen et al. |
| 2009/0002360 A1 | 1/2009 | Chen et al. |
| 2009/0010843 A1 | 1/2009 | Spee et al. |
| 2009/0130106 A1 | 5/2009 | Christopherson et al. |
| 2009/0148905 A1 | 6/2009 | Ashman et al. |
| 2009/0155275 A1 | 6/2009 | Wu et al. |
| 2009/0162359 A1 | 6/2009 | Klein et al. |
| 2009/0162360 A1 | 6/2009 | Klein et al. |
| 2009/0175851 A1 | 7/2009 | Klein et al. |
| 2009/0175867 A1 | 7/2009 | Thompson et al. |
| 2009/0214533 A1 | 8/2009 | Clynes |
| 2009/0232811 A1 | 9/2009 | Klein et al. |
| 2009/0234105 A1 | 9/2009 | Gervay-Hague et al. |
| 2009/0263392 A1 | 10/2009 | Igawa et al. |
| 2009/0274649 A1 | 11/2009 | Qu et al. |
| 2009/0280116 A1 | 11/2009 | Smith et al. |
| 2009/0324538 A1 | 12/2009 | Wong et al. |
| 2010/0015133 A1 | 1/2010 | Igawa et al. |
| 2010/0015153 A1 | 1/2010 | Moretta et al. |
| 2010/0028330 A1 | 2/2010 | Collins et al. |
| 2010/0047169 A1 | 2/2010 | Mandelboim et al. |
| 2010/0168393 A1 | 7/2010 | Clube et al. |
| 2010/0260704 A1 | 10/2010 | Berenguer et al. |
| 2010/0316645 A1 | 12/2010 | Imhof-Jung et al. |
| 2011/0014659 A1 | 1/2011 | Balazs et al. |
| 2011/0054151 A1 | 3/2011 | Lazar et al. |
| 2011/0091372 A1 | 4/2011 | Ghayur et al. |

(56) References Cited

U.S. PATENT DOCUMENTS

| | | |
|---|---|---|
| 2011/0150892 A1 | 6/2011 | Thudium et al. |
| 2011/0177073 A1 | 7/2011 | Van Berkel et al. |
| 2011/0177093 A1 | 7/2011 | Kalled et al. |
| 2011/0250170 A1 | 10/2011 | Pedretti et al. |
| 2011/0287056 A1 | 11/2011 | Gu et al. |
| 2011/0293613 A1 | 12/2011 | Brinkmann et al. |
| 2012/0034221 A1 | 2/2012 | Bonvini et al. |
| 2012/0039906 A1 | 2/2012 | Olive |
| 2012/0149876 A1 | 6/2012 | Von Kreudenstein et al. |
| 2012/0184716 A1 | 7/2012 | Fischer et al. |
| 2012/0201746 A1 | 8/2012 | Liu et al. |
| 2012/0213768 A1 | 8/2012 | Oh et al. |
| 2012/0294857 A1 | 11/2012 | Sentman et al. |
| 2013/0017200 A1 | 1/2013 | Scheer et al. |
| 2013/0022601 A1 | 1/2013 | Brinkmann et al. |
| 2013/0078249 A1 | 3/2013 | Ast et al. |
| 2013/0129723 A1 | 5/2013 | Blankenship et al. |
| 2013/0164293 A1 | 6/2013 | Florio et al. |
| 2013/0165638 A1 | 6/2013 | Hsu et al. |
| 2013/0178605 A1 | 7/2013 | Blein et al. |
| 2013/0195849 A1 | 8/2013 | Spreter Von Kreudenstein et al. |
| 2013/0243775 A1 | 9/2013 | Papadopoulos et al. |
| 2013/0266568 A1 | 10/2013 | Brinkmann et al. |
| 2013/0267686 A1 | 10/2013 | Brinkmann et al. |
| 2013/0273055 A1 | 10/2013 | Borges et al. |
| 2013/0273089 A1 | 10/2013 | Getts et al. |
| 2013/0280208 A1 | 10/2013 | Stepkowski et al. |
| 2013/0303396 A1 | 11/2013 | Igawa et al. |
| 2013/0317200 A1 | 11/2013 | Elson et al. |
| 2014/0037621 A1 | 2/2014 | Tsurushita et al. |
| 2014/0044728 A1 | 2/2014 | Takayanagi et al. |
| 2014/0051833 A1 | 2/2014 | Fischer et al. |
| 2014/0051835 A1 | 2/2014 | Dixit et al. |
| 2014/0072528 A1 | 3/2014 | Gerdes et al. |
| 2014/0072581 A1 | 3/2014 | Dixit et al. |
| 2014/0079689 A1 | 3/2014 | Elliott et al. |
| 2014/0079691 A1* | 3/2014 | McConnell ........ C07K 16/4291 530/391.1 |
| 2014/0099254 A1 | 4/2014 | Chang et al. |
| 2014/0154254 A1 | 6/2014 | Kannan et al. |
| 2014/0199294 A1 | 7/2014 | Mimoto et al. |
| 2014/0200331 A1 | 7/2014 | Corper et al. |
| 2014/0227265 A1 | 8/2014 | Wu et al. |
| 2014/0242075 A1 | 8/2014 | Parren et al. |
| 2014/0242077 A1 | 8/2014 | Choi et al. |
| 2014/0256916 A1 | 9/2014 | Kruip et al. |
| 2014/0308285 A1 | 10/2014 | Yan et al. |
| 2014/0322212 A1 | 10/2014 | Brogdon et al. |
| 2014/0322221 A1 | 10/2014 | Miller et al. |
| 2014/0348839 A1 | 11/2014 | Chowdhury et al. |
| 2014/0363426 A1 | 12/2014 | Moore et al. |
| 2014/0377269 A1 | 12/2014 | Mabry et al. |
| 2015/0017187 A1 | 1/2015 | Thanos et al. |
| 2015/0018529 A1 | 1/2015 | Humphreys et al. |
| 2015/0056199 A1 | 2/2015 | Kumar et al. |
| 2015/0098900 A1 | 4/2015 | Ebens et al. |
| 2015/0133638 A1 | 5/2015 | Wranik et al. |
| 2015/0166661 A1 | 6/2015 | Chen et al. |
| 2015/0166670 A1 | 6/2015 | Castoldi et al. |
| 2015/0175707 A1 | 6/2015 | De Jong et al. |
| 2015/0203591 A1 | 7/2015 | Yancopoulos et al. |
| 2015/0211001 A1 | 7/2015 | Ohrn et al. |
| 2015/0218260 A1 | 8/2015 | Klein et al. |
| 2015/0232560 A1 | 8/2015 | Heindl et al. |
| 2015/0315296 A1 | 11/2015 | Schaefer et al. |
| 2015/0337049 A1 | 11/2015 | Labrijn et al. |
| 2015/0344570 A1 | 12/2015 | Igawa et al. |
| 2015/0353636 A1 | 12/2015 | Parren et al. |
| 2015/0368351 A1 | 12/2015 | Vu et al. |
| 2015/0368352 A1 | 12/2015 | Liu |
| 2015/0376287 A1 | 12/2015 | Vu et al. |
| 2016/0015749 A1 | 1/2016 | Gottschalk et al. |
| 2016/0039947 A1 | 2/2016 | Demarest et al. |
| 2016/0075785 A1 | 3/2016 | Ast et al. |
| 2016/0102135 A1 | 4/2016 | Escobar-Cabrera |
| 2016/0114057 A1 | 4/2016 | Dixit et al. |
| 2016/0130347 A1 | 5/2016 | Bruenker et al. |
| 2016/0131654 A1 | 5/2016 | Berenson et al. |
| 2016/0145340 A1 | 5/2016 | Borges et al. |
| 2016/0145354 A1 | 5/2016 | Bacac et al. |
| 2016/0176973 A1 | 6/2016 | Kufer et al. |
| 2016/0194389 A1 | 7/2016 | Regula et al. |
| 2016/0229915 A1 | 8/2016 | Igawa et al. |
| 2016/0244523 A1 | 8/2016 | Blank et al. |
| 2016/0257763 A1 | 9/2016 | Von Kreudenstein et al. |
| 2016/0264685 A1 | 9/2016 | Fouque et al. |
| 2016/0297885 A1 | 10/2016 | Kuo et al. |
| 2016/0311915 A1 | 10/2016 | Puléet al. |
| 2016/0368985 A1 | 12/2016 | Hotzel et al. |
| 2016/0368988 A1 | 12/2016 | Bakker et al. |
| 2017/0022284 A1 | 1/2017 | Timmer et al. |
| 2017/0035905 A1 | 2/2017 | Abrams et al. |
| 2017/0037128 A1 | 2/2017 | Little et al. |
| 2017/0051068 A1 | 2/2017 | Pillarisetti et al. |
| 2017/0066827 A1 | 3/2017 | Puléet al. |
| 2017/0151281 A1 | 6/2017 | Wagner et al. |
| 2017/0204176 A1 | 7/2017 | Bonvini et al. |
| 2017/0269092 A1 | 9/2017 | Kralovics |
| 2017/0275362 A1 | 9/2017 | Brentjens et al. |
| 2017/0298445 A1 | 10/2017 | Ogg |
| 2017/0334998 A1 | 11/2017 | Puléet al. |
| 2017/0368169 A1* | 12/2017 | Loew .................... C07K 16/30 |
| 2018/0153938 A1 | 6/2018 | Keating et al. |
| 2018/0235887 A1 | 8/2018 | Garidel et al. |
| 2018/0256716 A1 | 9/2018 | Schendel et al. |
| 2019/0062448 A1 | 2/2019 | Soros et al. |
| 2019/0209612 A1 | 7/2019 | Puléet al. |
| 2019/0315883 A1 | 10/2019 | Ast et al. |
| 2019/0322763 A1 | 10/2019 | Ast et al. |
| 2020/0071417 A1 | 3/2020 | Loew et al. |
| 2020/0109195 A1 | 4/2020 | Watkins et al. |
| 2020/0129638 A1 | 4/2020 | Van Berkel et al. |
| 2020/0140549 A1 | 5/2020 | Cordoba et al. |
| 2020/0172591 A1 | 6/2020 | Hosse et al. |
| 2020/0172868 A1 | 6/2020 | Wickham et al. |
| 2020/0200756 A1 | 6/2020 | Puléet al. |
| 2020/0230208 A1 | 7/2020 | Wang et al. |
| 2020/0277384 A1 | 9/2020 | Chang et al. |
| 2020/0291089 A1 | 9/2020 | Loew et al. |
| 2020/0299349 A1 | 9/2020 | Garcia et al. |
| 2020/0306301 A1 | 10/2020 | Andresen et al. |
| 2020/0308242 A1 | 10/2020 | Lowe et al. |
| 2020/0317787 A1 | 10/2020 | Li et al. |
| 2020/0332003 A1 | 10/2020 | Britanova et al. |
| 2020/0377571 A1 | 12/2020 | Loew et al. |
| 2020/0385472 A1 | 12/2020 | Loew et al. |
| 2021/0009711 A1 | 1/2021 | Loew et al. |
| 2021/0024631 A1 | 1/2021 | Kley et al. |
| 2021/0079114 A1 | 3/2021 | Hudson |
| 2021/0137982 A1 | 5/2021 | Loew et al. |
| 2021/0198369 A1 | 7/2021 | Chang et al. |
| 2021/0221863 A1 | 7/2021 | Kang et al. |
| 2021/0230311 A1 | 7/2021 | Nezu et al. |
| 2021/0246227 A1 | 8/2021 | Loew et al. |
| 2021/0277119 A1 | 9/2021 | Tan et al. |
| 2021/0363250 A1 | 11/2021 | Kamikawaji et al. |
| 2021/0371523 A1 | 12/2021 | Loew et al. |
| 2021/0380670 A1 | 12/2021 | Loew et al. |
| 2021/0380691 A1 | 12/2021 | Loew et al. |
| 2021/0380692 A1 | 12/2021 | Loew et al. |
| 2021/0380715 A1 | 12/2021 | Yoshida et al. |
| 2022/0064255 A1 | 3/2022 | Loew et al. |
| 2022/0064297 A1 | 3/2022 | Tan et al. |
| 2022/0112286 A1 | 4/2022 | Britanova et al. |
| 2022/0288200 A1 | 9/2022 | Loew et al. |
| 2023/0025484 A1 | 1/2023 | Tan et al. |
| 2023/0031734 A1 | 2/2023 | Tan et al. |
| 2023/0034161 A1 | 2/2023 | Tan et al. |
| 2023/0048244 A1 | 2/2023 | Loew |
| 2023/0102344 A1 | 3/2023 | Katragadda et al. |
| 2023/0127740 A1 | 4/2023 | Tan et al. |
| 2023/0142522 A1 | 5/2023 | Tan et al. |
| 2023/0174650 A1 | 6/2023 | Tan et al. |
| 2023/0192848 A1 | 6/2023 | Loew |

(56) References Cited

U.S. PATENT DOCUMENTS

| | | | |
|---|---|---|---|
| 2023/0227552 A1 | 7/2023 | Tan et al. |
| 2023/0333112 A1 | 10/2023 | Loew et al. |
| 2023/0348593 A1 | 11/2023 | Loew et al. |
| 2023/0357395 A1 | 11/2023 | Loew et al. |
| 2023/0374133 A1 | 11/2023 | Tan et al. |
| 2024/0002543 A1 | 1/2024 | Loew et al. |
| 2024/0076377 A1 | 3/2024 | Tan et al. |
| 2024/0301060 A1 | 9/2024 | Tan et al. |
| 2024/0400990 A1 | 12/2024 | Hayday et al. |
| 2024/0409636 A1 | 12/2024 | Hsu et al. |

FOREIGN PATENT DOCUMENTS

| | | | |
|---|---|---|---|
| CA | 3214757 A1 | 10/2022 |
| CN | 101802010 A | 8/2010 |
| CN | 101985476 A | 3/2011 |
| CN | 104203981 A | 12/2014 |
| CN | 104769103 A | 7/2015 |
| CN | 105916876 A | 8/2016 |
| CN | 106103475 A | 11/2016 |
| CN | 106163547 A | 11/2016 |
| CN | 107206024 A | 9/2017 |
| CN | 107903325 A | 4/2018 |
| CN | 108026171 A | 5/2018 |
| CN | 108949698 A | 12/2018 |
| CN | 109153728 A | 1/2019 |
| DE | 10261223 A1 | 7/2004 |
| EP | 0125023 A1 | 11/1984 |
| EP | 0171496 A2 | 2/1986 |
| EP | 0173494 A2 | 3/1986 |
| EP | 0184187 A2 | 6/1986 |
| EP | 0346087 A2 | 12/1989 |
| EP | 0368684 A1 | 5/1990 |
| EP | 0388151 A1 | 9/1990 |
| EP | 0404097 A2 | 12/1990 |
| EP | 0519596 A1 | 12/1992 |
| EP | 0171496 B1 | 5/1993 |
| EP | 0616640 A1 | 9/1994 |
| EP | 0425235 B1 | 9/1996 |
| EP | 0403156 B1 | 9/1997 |
| EP | 1176195 A1 | 1/2002 |
| EP | 0125023 B2 | 3/2002 |
| EP | 0368684 B2 | 9/2004 |
| EP | 0616640 B1 | 9/2004 |
| EP | 1301605 B1 | 11/2005 |
| EP | 1870459 A1 | 12/2007 |
| EP | 2581113 A1 | 4/2013 |
| EP | 1846020 B1 | 8/2013 |
| EP | 2699259 A1 | 2/2014 |
| EP | 2467165 B1 | 1/2015 |
| EP | 2847231 A1 | 3/2015 |
| EP | 2982694 A1 | 2/2016 |
| EP | 3023437 A1 | 5/2016 |
| EP | 1870459 B1 | 6/2016 |
| EP | 2982694 B1 | 6/2016 |
| EP | 3029068 A1 | 6/2016 |
| EP | 2699259 B1 | 7/2016 |
| EP | 3055329 A1 | 8/2016 |
| EP | 3137500 A1 | 3/2017 |
| EP | 3059246 B1 | 7/2018 |
| EP | 2723380 B1 | 8/2019 |
| EP | 3294768 B1 | 8/2019 |
| EP | 3149031 B1 | 12/2019 |
| EP | 3590967 A1 | 1/2020 |
| EP | 3626739 A1 | 3/2020 |
| EP | 3642228 A1 | 4/2020 |
| EP | 3189132 B1 | 6/2020 |
| EP | 3303392 B1 | 8/2020 |
| EP | 4087871 A1 | 11/2022 |
| GB | 2188638 A | 10/1987 |
| GB | 2599228 A | 3/2022 |
| GB | 2616354 A | 9/2023 |
| JP | H0787994 A | 4/1995 |
| JP | H08502246 A | 3/1996 |
| JP | H09509307 A | 9/1997 |
| JP | 2011524743 A | 9/2011 |
| JP | 2013515509 A | 5/2013 |
| JP | 2014527802 A | 10/2014 |
| JP | 2016512557 A | 4/2016 |
| JP | 2017143838 A | 8/2017 |
| JP | 2018517712 A | 7/2018 |
| JP | 2018531939 A | 11/2018 |
| WO | WO-8500817 A1 | 2/1985 |
| WO | WO-8601533 A1 | 3/1986 |
| WO | WO-8702671 A1 | 5/1987 |
| WO | WO-9002809 A1 | 3/1990 |
| WO | WO-9100906 A1 | 1/1991 |
| WO | WO-9103493 A1 | 3/1991 |
| WO | WO-9110741 A1 | 7/1991 |
| WO | WO-9117271 A1 | 11/1991 |
| WO | WO-9201047 A1 | 1/1992 |
| WO | WO-9203917 A1 | 3/1992 |
| WO | WO-9203918 A1 | 3/1992 |
| WO | WO-9209690 A2 | 6/1992 |
| WO | WO-9215679 A1 | 9/1992 |
| WO | WO-9218619 A1 | 10/1992 |
| WO | WO-9220791 A1 | 11/1992 |
| WO | WO-9209690 A3 | 12/1992 |
| WO | WO-9301161 A1 | 1/1993 |
| WO | WO-9301288 A1 | 1/1993 |
| WO | WO-9308829 A1 | 5/1993 |
| WO | WO-9311161 A1 | 6/1993 |
| WO | WO-9311236 A1 | 6/1993 |
| WO | WO-9323537 A1 | 11/1993 |
| WO | WO-9404678 A1 | 3/1994 |
| WO | WO-9405801 A1 | 3/1994 |
| WO | WO-9409131 A1 | 4/1994 |
| WO | WO-9411026 A2 | 5/1994 |
| WO | WO-9412625 A2 | 6/1994 |
| WO | WO-9425591 A1 | 11/1994 |
| WO | WO-9429351 A2 | 12/1994 |
| WO | WO-9509917 A1 | 4/1995 |
| WO | WO-9516038 A2 | 6/1995 |
| WO | WO-9637621 A2 | 11/1996 |
| WO | WO-9730087 A1 | 8/1997 |
| WO | WO-9814206 A1 | 4/1998 |
| WO | WO-9856915 A2 | 12/1998 |
| WO | WO-9858964 A1 | 12/1998 |
| WO | WO-9904820 A2 | 2/1999 |
| WO | WO-9916873 A1 | 4/1999 |
| WO | WO-9922764 A1 | 5/1999 |
| WO | WO-9945110 A1 | 9/1999 |
| WO | WO-9951642 A1 | 10/1999 |
| WO | WO-9964460 A1 | 12/1999 |
| WO | WO-0006605 A2 | 2/2000 |
| WO | WO-0034784 A1 | 6/2000 |
| WO | WO-0060070 A1 | 10/2000 |
| WO | WO-0061739 A1 | 10/2000 |
| WO | WO-0104144 A2 | 1/2001 |
| WO | WO-0129246 A1 | 4/2001 |
| WO | WO-0136630 A2 | 5/2001 |
| WO | WO-0164942 A1 | 9/2001 |
| WO | WO-0198357 A2 | 12/2001 |
| WO | WO-0231140 A1 | 4/2002 |
| WO | WO-02070647 A2 | 9/2002 |
| WO | WO-02072635 A2 | 9/2002 |
| WO | WO-03002609 A2 | 1/2003 |
| WO | WO-03011878 A2 | 2/2003 |
| WO | WO-03014161 A2 | 2/2003 |
| WO | WO-03056914 A1 | 7/2003 |
| WO | WO-03084570 A1 | 10/2003 |
| WO | WO-03085107 A1 | 10/2003 |
| WO | WO-03085119 A1 | 10/2003 |
| WO | WO-03093318 A1 | 11/2003 |
| WO | WO-2004003019 A2 | 1/2004 |
| WO | WO-2004024927 A1 | 3/2004 |
| WO | WO-2004033685 A1 | 4/2004 |
| WO | WO-2004056312 A2 | 7/2004 |
| WO | WO-2004056392 A1 | 7/2004 |
| WO | WO-2004056873 A1 | 7/2004 |
| WO | WO-2004057002 A2 | 7/2004 |
| WO | WO-2004058821 A2 | 7/2004 |
| WO | WO-2004065540 A2 | 8/2004 |
| WO | WO-2004081026 A2 | 9/2004 |

(56) References Cited

FOREIGN PATENT DOCUMENTS

| | | |
|---|---|---|
| WO | WO-2004081051 A1 | 9/2004 |
| WO | WO-2004101790 A1 | 11/2004 |
| WO | WO-2004106368 A1 | 12/2004 |
| WO | WO-2005035572 A2 | 4/2005 |
| WO | WO-2005035586 A1 | 4/2005 |
| WO | WO-2005035778 A1 | 4/2005 |
| WO | WO-2005053742 A1 | 6/2005 |
| WO | WO-2005100402 A1 | 10/2005 |
| WO | WO-2006000830 A2 | 1/2006 |
| WO | WO-2006020258 A2 | 2/2006 |
| WO | WO-2006029879 A2 | 3/2006 |
| WO | WO-2006044908 A2 | 4/2006 |
| WO | WO-2006079372 A1 | 8/2006 |
| WO | WO-2006106905 A1 | 10/2006 |
| WO | WO-2006121168 A1 | 11/2006 |
| WO | WO-2006135886 A2 | 12/2006 |
| WO | WO-2007005874 A2 | 1/2007 |
| WO | WO-2007044887 A2 | 4/2007 |
| WO | WO-2007059782 A1 | 5/2007 |
| WO | WO-2007005874 A3 | 7/2007 |
| WO | WO-2007095338 A2 | 8/2007 |
| WO | WO-2007110205 A2 | 10/2007 |
| WO | WO-2007137760 A2 | 12/2007 |
| WO | WO-2008017859 A2 | 2/2008 |
| WO | WO-2008077546 A1 | 7/2008 |
| WO | WO-2008087219 A1 | 7/2008 |
| WO | WO-2008119353 A1 | 10/2008 |
| WO | WO-2009021754 A2 | 2/2009 |
| WO | WO-2009068630 A1 | 6/2009 |
| WO | WO-2009077993 A2 | 6/2009 |
| WO | WO-2009089004 A1 | 7/2009 |
| WO | WO-2009101611 A1 | 8/2009 |
| WO | WO-2009103538 A1 | 8/2009 |
| WO | WO-2009114335 A2 | 9/2009 |
| WO | WO-2009147137 A1 | 12/2009 |
| WO | WO-2010019570 A2 | 2/2010 |
| WO | WO-2010027797 A1 | 3/2010 |
| WO | WO-2010027827 A2 | 3/2010 |
| WO | WO-2010029513 A2 | 3/2010 |
| WO | WO-2010077634 A1 | 7/2010 |
| WO | WO-2010129304 A2 | 11/2010 |
| WO | WO-2011066342 A2 | 6/2011 |
| WO | WO-2011090762 A1 | 7/2011 |
| WO | WO-2011131746 A2 | 10/2011 |
| WO | WO-2011155607 A1 | 12/2011 |
| WO | WO-2012079000 A1 | 6/2012 |
| WO | WO-2012088309 A1 | 6/2012 |
| WO | WO-2012107417 A1 | 8/2012 |
| WO | WO-2012131555 A2 | 10/2012 |
| WO | WO-2012138475 A1 | 10/2012 |
| WO | WO-2012143498 A1 | 10/2012 |
| WO | WO-2013019615 A2 | 2/2013 |
| WO | WO-2013033626 A2 | 3/2013 |
| WO | WO-2013037484 A2 | 3/2013 |
| WO | WO-2013060867 A2 | 5/2013 |
| WO | WO-2013079174 A1 | 6/2013 |
| WO | WO-2013103912 A1 | 7/2013 |
| WO | WO-2013170168 A1 | 11/2013 |
| WO | WO-2014008218 A1 | 1/2014 |
| WO | WO-2014100823 A1 | 6/2014 |
| WO | WO-2014159940 A1 | 10/2014 |
| WO | WO-2015052230 A1 | 4/2015 |
| WO | WO-2015066379 A2 | 5/2015 |
| WO | WO-2015095811 A2 | 6/2015 |
| WO | WO-2015107015 A1 | 7/2015 |
| WO | WO-2015107025 A1 | 7/2015 |
| WO | WO-2015107026 A1 | 7/2015 |
| WO | WO-2015121383 A1 | 8/2015 |
| WO | WO-2015127158 A1 | 8/2015 |
| WO | WO-2015132598 A1 | 9/2015 |
| WO | WO-2015164815 A1 | 10/2015 |
| WO | WO-2015166073 A1 | 11/2015 |
| WO | WO-2015181805 A1 | 12/2015 |
| WO | WO-2015197582 A1 | 12/2015 |
| WO | WO-2015197593 A1 | 12/2015 |
| WO | WO-2015197598 A2 | 12/2015 |
| WO | WO-2016016299 A1 | 2/2016 |
| WO | WO-2016019969 A1 | 2/2016 |
| WO | WO-2016026943 A1 | 2/2016 |
| WO | WO-2016033555 A1 | 3/2016 |
| WO | WO-2016071376 A2 | 5/2016 |
| WO | WO-2016071377 A1 | 5/2016 |
| WO | WO-2016079081 A1 | 5/2016 |
| WO | WO-2016087416 A1 | 6/2016 |
| WO | WO-2016087514 A1 | 6/2016 |
| WO | WO-2016087650 A1 | 6/2016 |
| WO | WO-2016090327 A2 | 6/2016 |
| WO | WO-2016110468 A1 | 7/2016 |
| WO | WO-2016110584 A1 | 7/2016 |
| WO | WO-2016115274 A1 | 7/2016 |
| WO | WO-2016118641 A1 | 7/2016 |
| WO | WO-2016168149 A1 | 10/2016 |
| WO | WO-2016180969 A1 | 11/2016 |
| WO | WO-2016193301 A1 | 12/2016 |
| WO | WO-2017021349 A1 | 2/2017 |
| WO | WO-2017021450 A1 | 2/2017 |
| WO | WO-2017037634 A1 | 3/2017 |
| WO | WO-2017040930 A2 | 3/2017 |
| WO | WO-2017055391 A1 | 4/2017 |
| WO | WO-2017059551 A1 | 4/2017 |
| WO | WO-2017062604 A1 | 4/2017 |
| WO | WO-2017077382 A1 | 5/2017 |
| WO | WO-2017134140 A1 | 8/2017 |
| WO | WO-2017165464 A1 | 9/2017 |
| WO | WO-2017167919 A1 | 10/2017 |
| WO | WO-2017180913 A2 | 10/2017 |
| WO | WO-2018057955 A1 | 3/2018 |
| WO | WO-2018098365 A2 | 5/2018 |
| WO | WO-2018144777 A2 | 8/2018 |
| WO | WO-2018201047 A1 | 11/2018 |
| WO | WO-2018224844 A1 * | 12/2018 ............. A61K 35/17 |
| WO | WO-2018237192 A1 | 12/2018 |
| WO | WO-2019005641 A1 | 1/2019 |
| WO | WO-2019035938 A1 | 2/2019 |
| WO | WO-2019040700 A1 | 2/2019 |
| WO | WO-2019040780 A1 | 2/2019 |
| WO | WO-2019055677 A1 | 3/2019 |
| WO | WO-2019067805 A1 | 4/2019 |
| WO | WO-2019086865 A1 | 5/2019 |
| WO | WO-2019101695 A1 | 5/2019 |
| WO | WO-2019132738 A1 | 7/2019 |
| WO | WO-2019139987 A1 | 7/2019 |
| WO | WO-2019158764 A1 | 8/2019 |
| WO | WO-2019178362 A1 | 9/2019 |
| WO | WO-2019178364 A2 | 9/2019 |
| WO | WO-2019178364 A3 | 10/2019 |
| WO | WO-2019191519 A1 | 10/2019 |
| WO | WO-2019226617 A1 | 11/2019 |
| WO | WO-2019231920 A1 | 12/2019 |
| WO | WO-2020005819 A1 | 1/2020 |
| WO | WO-2020010250 A2 | 1/2020 |
| WO | WO-2020018708 A1 | 1/2020 |
| WO | WO-2020010250 A3 | 2/2020 |
| WO | WO-2020025928 A1 | 2/2020 |
| WO | WO-2020057646 A1 | 3/2020 |
| WO | WO-2020082048 A1 | 4/2020 |
| WO | WO-2020084290 A1 | 4/2020 |
| WO | WO-2020086758 A1 | 4/2020 |
| WO | WO-2020088459 A1 | 5/2020 |
| WO | WO-2020089644 A1 | 5/2020 |
| WO | WO-2020091635 A2 | 5/2020 |
| WO | WO-2020106708 A1 | 5/2020 |
| WO | WO-2020139171 A1 | 7/2020 |
| WO | WO-2020139175 A2 | 7/2020 |
| WO | WO-2020142672 A2 | 7/2020 |
| WO | WO-2020142672 A3 | 8/2020 |
| WO | WO-2020172571 A1 | 8/2020 |
| WO | WO-2020172596 A1 | 8/2020 |
| WO | WO-2020172598 A1 | 8/2020 |
| WO | WO-2020172601 A1 | 8/2020 |
| WO | WO-2020172605 A1 | 8/2020 |
| WO | WO-2020183245 A2 | 9/2020 |
| WO | WO-2020249757 A1 | 12/2020 |
| WO | WO-2021089704 A1 | 5/2021 |

(56) References Cited

FOREIGN PATENT DOCUMENTS

| WO | WO-2021097325 | | 5/2021 |
|---|---|---|---|
| WO | WO-2021138407 | A2 | 7/2021 |
| WO | WO-2021138474 | A2 | 7/2021 |
| WO | WO-2021140190 | A1 | 7/2021 |
| WO | WO-2021138474 | A3 | 9/2021 |
| WO | WO-2021188454 | A1 | 9/2021 |
| WO | WO-2021217085 | A1 | 10/2021 |
| WO | WO-2022046920 | A2 | 3/2022 |
| WO | WO-2022046922 | A2 | 3/2022 |
| WO | WO-2022047046 | A1 | 3/2022 |
| WO | WO-2022046920 | A3 | 4/2022 |
| WO | WO-2022046922 | A3 | 4/2022 |
| WO | WO-2022179580 | A1 | 9/2022 |
| WO | WO-2022216993 | A2 | 10/2022 |
| WO | WO-2022216993 | A3 | 11/2022 |
| WO | WO-2022240688 | A1 | 11/2022 |
| WO | WO-2023081412 | A2 | 5/2023 |
| WO | WO-2023122206 | A2 | 6/2023 |
| WO | WO-2023141297 | A2 | 7/2023 |
| WO | WO-2023081412 | A3 | 8/2023 |
| WO | WO-2023122206 | A3 | 8/2023 |
| WO | WO-2023141297 | A3 | 8/2023 |
| WO | WO-2024081329 | A1 | 4/2024 |
| WO | WO-2024081381 | A1 | 4/2024 |
| WO | WO-2024197082 | A2 | 9/2024 |
| WO | WO-2024226532 | A2 | 10/2024 |
| WO | WO-2024227109 | A1 | 10/2024 |
| WO | WO-2024197082 | A3 | 11/2024 |
| WO | WO-2024254611 | A2 | 12/2024 |
| WO | WO-2024226532 | A3 | 1/2025 |

OTHER PUBLICATIONS

Akiyama et al.: TNFalpha induces rapid activation and nuclear translocation of telomerase in human lymphocytes. Biochem Biophys Res Commun. 316(2):528-532 (2004).

Ala-Aho, Risto, et al., Collagenases in Cancer. Biochimie 87(3-4):273-286 (2005).

Al-Aghbar, M.A. et al., "High-affinity ligands can trigger T cell receptor signaling without CD45 segregation," Frontiers in Immunology, 2018;9(713):1-18.

Ali et al.: Modulation of human natural killer cytotoxicity by influenza virus and its subunit protein. Immunology 52(4):687-695 (1984).

Al-Lazikani, B. et al., "Standard Conformations for Canonical Structures of Immunoglobulins", J. Mol. Biol., 1997, vol. 273, pp. 927-948.

Altschul, S F, et al., Basic Local Alignment Search Tool. Journal of Molecular Biology 215(3):403-410 (1990).

Altschul, Stephen, et al., Gapped BLAST and PSI-Blast: A New Generation of Protein Database Search Programs. Nucleic Acids Research 25(17):3389-3402 (1997).

Amarante-Mendes GP, Griffith TS. Therapeutic applications of TRAIL receptor agonists in cancer and beyond. Pharmacol Ther. Nov. 2015;155:117-31. Epub Sep. 5, 2015.

Arai, R. et al., "Design of the linkers which effectively separate domains of a bifunctional fusion protein", Protein Engineering, 2001, vol. 14, No. 8, pp. 529-532.

Arenas-Ramirez et al.: Interleukin-2: Biology, Design and Application. Trends in Immunology 36(12):763-777 (2015).

Arnon, T.I. et al., "Recognition of viral hemagglutinins by NKp44 but not by NKp30", Eur J. Immunol., 2001, vol. 31, No. 9, pp. 2680-2689.

Aslan, J.E. et al., "S6K1 and mTOR regulate Rac1-driven platelet activation and aggregation", Blood, 2011, vol. 118, No. 11, pp. 3129-3136.

Aversa, Ilenia, et al., Molecular T-Cell Repertoire Analysis as Source of Prognostic and Predictive Biomarkers for Checkpoint blockade Immunotherapy. International Journal of Molecular Sciences 21(7):2378, 1-19 (2020).

Banerjee, Hridesh, et al., 33rd Annual Meeting & Pre-Conference Programs of the Society for Immunotherapy of Cancer (SITC). Journal for Immunotherapy of Cancer 6(1):1-192 (2018).

Barbas, Carlos, et al., Assembly of Combinatorial Antibody Libraries on Phage Surfaces: The Gene III Site. Proceedings of the National Academy of Sciences of the United States of America 88(18):7978-7982 (1991).

Beidler, C B, et al., Cloning and High Level Expression of a Chimeric Antibody With Specificity for Human Carcinoembryonic Antigen. Journal of Immunology 141(11):4053-4060 (1988).

Berge, Ten, et al., Selective Expansion of a Peripheral Blood Cd8+ Memory T Cell Subset Expressing Both Granzyme B and L-selectin During Primary Viral Infection in Renal Allograft Recipients. Transplantation Proceedings 30(8):3975-3977 (1998).

Better, M. et al., "*Escherichia coli* Secretion of an Active Chimeric Antibody Fragment", Science, 1988, vol. 240, No. 4855, pp. 1041-1043.

Beun, G. et al., "T cell Retargeting Using Bispecific Monoclonal Antibodies in a Rat Colon Carcinoma Model", The Journal of Immunology, 1993, vol. 150, No. 6, pp. 2305-2315.

Bierer, B E, et al., Cyclosporin a and Fk506: Molecular Mechanisms of Immunosuppression and Probes for Transplantation Biology. Current Opinion in Immunology 5(5):763-773 (1993).

Bird, R.E. et al., Single-Chain Antigen-binding Proteins, Science, vol. 242, 4877 (1988):423-426.

Bluemel, C. et al., "Epitope distance to the target cell membrane and antigen size determine the potency of T cell-mediated lysis by BiTE antibodies specific for a large melanoma surface antigen", Cancer Immunology, Immunotherapy, 2010, vol. 59, No. 8, pp. 1197-1209.

Bolt, S. et al., "The generation of a humanized, non-mitogenic CD3 monoclonal antibody which retains in vitro immunosuppressive properties," Eur. J. Immunol., 1993;23:403-411.

Breman, E. et al., "Overcoming target driven fratricide for T Cell Therapy," Frontiers in Immunology, 2018;9(2940):1-11.

Bruggemann, M. et al., Designer Mice: The Production of Human Antibody Repertoires in Transgenic Animals, Terhorst C. Malavasi F, Albertini A (eds): Generation of Antibodies by Cell and Gene Immortalization, Year Immunol, 1993, vol. 7, pp. 33-40.

Bruggemann, M. et al., "Human antibody production in transgenic mice: expression from 100kb of the human IgH locus", Eur J. Immunol, 1991, vol. 21, pp. 1323-1326.

Buchwald et al. Long-term, continuous intravenous heparin administration by an implantable infusion pump in ambulatory patients with recurrent venous thrombosis. Surgery 88:507-516 (1980).

Cadwell, R. C. et al., "Randomization of Genes by PCR Mutagenesis", PCR Methods Appl., 1992, vol. 2, No. 1, pp. 28-33.

Cain, Chris, et al., Crossing over to Bispecificity. SciBX 4(28):1-3 (2011).

Chang et al.: A therapeutic T cell receptor mimic antibody targets tumor-associated PRAME peptide/HLA-I antigens. J Clin Invest. 127(7):2705-2718 (2017).

Chao, G. et al., "Isolating and engineering human antibodies using yeast surface display", Nature Protocols, 2006, vol. 1, No. 2, pp. 755-768.

Chaudry, et al. EpCAM an immunotherapeutic target for gastrointestinal malignancy: current experience and future challenges. Br J Cancer. Apr. 10, 2007;96(7):1013-9. Epub Feb. 27, 2007.

Chen et al.: Chromosome X-encoded cancer/testis antigens show distinctive expression patterns in developing gonads and in testicular seminoma. Hum Reprod. 26(12):3232-3243 doi:10.1093/humrep/der330 (2011).

Chen et al.: The nuclear localization sequences of the BRCA1 protein interact with the importin-alpha subunit of the nuclear transport signal receptor. J Biol Chem. 271(51):32863-32868 (1996).

Chiang, E. et al., "Abstract 3527: Potent anti-tumor activity of AbGn-100, an anti-CD326 x anti-TCR bispecific antibody to CD326-expressing solid tumors," Cancer Res., 2012;72(8_supplement):3527.

Chichili, V.P.R. et al., "Linkers in the structural biology of protein-protein interactions," Protein Science, 2013;22:153-167.

Chinese Patent Application No. 201780028089.4 2nd Office Action dated Apr. 18, 2022.

(56) References Cited

OTHER PUBLICATIONS

Cho, Bryan, et al., Single-Chain Fv/Folate Conjugates Mediate Efficient Lysis of Folate—Receptor-Positive Tumor Cells. Bioconjugate Chemistry 8(3):338-346 (1997).

Chothia, C. et al., "Canonical Structures for the Hypervariable Regions of Immunoglobulins", J. Mol. Biol, 1987, vol. 196, pp. 901-917.

Chothia et al., Structural repertoire of the human VH segments. J Mol Biol 227:799-817 (1992).

Ciccone, E. et al., "A monoclonal antibody specific for a common determinant of the human T cell receptor gamma/delta directly activates CD3+WT31-lymphocytes to express their functional program(s)," J Exp Med., 1988;168(1):1-11.

Clackson, T. et al., Making antibody fragments using phage display libraries, Nature, 1991, vol. 352, pp. 624-628.

Colcher, David, et al., Single-Chain Antibodies in Pancreatic Cancer. Annals of the New York Academy of Sciences 880:263-280 (1999).

Coloma, J. et al., "Design and production of novel tetravalent bispecific antibodies", Nature Biotech, 1997, vol. 15, pp. 159-163.

Costa-Mattioli, Mauro, et al., RAPping Production of type I Interferon in pDCs through mTOR. Nature Immunology 9(10):1097-1099 (2008).

Cui, et al., "T cell receptor B-chain repertoire analysis of tumor-infiltrating lymphocytes in pancreatic cancer" Cancer Science (2018) 60-71.

Dao, Tao, et al., Targeting the Intracellular Wt1 Oncogene Product With a Therapeutic Human Antibody. Science Translational Medicine 5(176):176ra33, 1-22 (2013).

Davis, J. et al., "SEEDbodies: fusion proteins based on strand-exchange engineered domain (Seed) CH3 heterodimers in an Fc analogue platform for asymmetric binders or immunofusions and bispecific antibodies", Protein Engineering, Design & Selection, 2010, vol. 23, No. 4, pp. 195-202.

Dela Cruz et al.: Anti-HER2/neu IgG3-(IL-2) and anti-HER2/neu IgG3-(GM-CSF) promote HER2/neu processing and presentation by dendritic cells: Implications in immunotherapy and vaccination strategies. Molecular Immunology 43(6):667-676 (2006).

Dickopf, S. et a., "Formal and geometries matter: Structure-based design defines the functionality of bispecific antibodies", Computational and Structural Biotechnology Journal, 2020, vol. 18, pp. 1221-1227.

Dimasi et al. Development of a trispecific antibody designed to simultaneously and efficiently target three different antigens on tumor cells. Mol Pharm 12(9):3490-3501 (2015).

Doyle, Sean, et al., IRF3 Mediates a TLR3/TLR4-Specific Antiviral Gene Program. Immunity 17(3):251-263 (2002).

Duhen et al., Co-expression of $CD_{39}$ and $CD_{103}$ identifies tumor-reactive CD8 T cells in human solid tumors. Nat Commun. 9(1):2724, pp. 1-13 (2018).

During, M J, et al., Controlled Release of Dopamine From a Polymeric Brain Implant: in Vivo Characterization. American Neurological Association 25(4):351-356 (1989).

El Achi, H. et al., "CD123 as a Biomarker in Hematolymphoid Malignancies: Principles of Detection and Targeted Therapies," Cancers, 2020;12(11):3087.

European Patent Application No. 17 718 441.3 Office Action dated Jan. 24, 2022.

European Search Report issued in EP20736073, dated Aug. 2, 2022.

Falini et al.: Cytoplasmic nucleophosmin in acute myelogenous leukemia with a normal karyotype. N Engl J Med. 352(3):254-266 doi:10.1056/NEJMoa041974 (2005).

Farrar et al.: The Molecular Cell Biology of Interferon-gamma and Its Receptor. Annu Rev Immunol 11:571-611 (1993).

Fernandez-Malave, Edgar, et al., An Natural Anti-T-Cell Receptor Monoclonal Antibody Protects Against Experimental Autoimmune Encephalomyelitis. Journal of Neuroimmunology 234(1-2):63-70 (2011).

Foley, K.. et al., Combination immunotherapies implementing adoptive T-cell transfer for advanced-stage melanoma, Melanoma Research, vol. 28, 3 (2018): 171-184.

Frost, Gregory, et al., A Microtiter-Based Assay for Hyaluronidase Activity Not Requiring Specialized Reagents. Analytical Biochemistry 251(2):263-269 (1997).

Fuchs, P. et al., "Targeting Recombinant Antibodies to the surface of *Escherichia coli*: Fusion to the Peptidoglycan associated Lipoprotein", Nature Publishing Group, 1991, vol. 9, No. 12, pp. 1369-1372.

Funayama et al.: Embryonic axis induction by the armadillo repeat domain of beta-catenin: evidence for intracellular signaling. J Cell Biol. 128(5):959-968 (1995).

Gao et al.: Alg14 recruits Alg13 to the cytoplasmic face of the endoplasmic reticulum to form a novel bipartite UDP-N-acetylglucosamine transferase required for the second step of N-linked glycosylation. J Biol Chem. 280(43):36254-36262 doi:10.1074/jbc.M507569200 (2005).

Garland, R.J., et al., "The use of Teflon cell culture bags to expand functionally active CD8+ cytotoxic T lymphocytes", Journal of Immunological Methods, 1999, vol. 227, pp. 53-63.

Garrard, L. et al., "FAB Assembly and Enrichment in a Monovalent Phage Display System", Nature Publishing Group, 1991, vol. 9, pp. 1373-1377.

Garrity, David, et al., The Activating NKG2D Receptor Assembles in the Membrane With Two Signaling Dimers Into a Hexameric Structure. Proceedings of the National Academy of Sciences of the United States of America 102(21):7641-7646 (2005).

GB Exam Report for GB2109794.4 dated Jun. 21, 2020.

Geissinger, E. et al., "Identification of the Tumor Cells in Peripheral T-Cell Lymphomas by Combined Polymerase Chain Reaction-Based T-Cell Receptor [3 Spectrotyping and Immunohistological Detection with T-Cell Receptor [3 Chain Variable Region Segment-Specific Antibodies," J. of Mol Diag., 2005;7(4):455-464.

Gillies, S.D. et al., "Bi-functional cytokine fusion proteins for gene therapy and antibody-targeted treatment of cancer," Cancer Immunol Immunotherapy, 2002;51:449-460.

Gjerstorff et al.: GAGE cancer-germline antigens are recruited to the nuclear envelope by germ cell-less (GCL). PLoS One 7(9):e45819:1-12 doi:10.1371/journal.pone.0045819 (2012).

Goel, M. e a., "Plasticity within the Antigen-Combining site may manifest as molecular mimicry in the humoral immune response," J Immunology, 2004;173(12):7358-7367.

Gohal, G. et al., "T-cell receptor phenotype pattern in atopic children using commercial fluorescently labeled antibodies against 21 human class-specific v segments for the torβ chain (vβ) of peripheral blood: a cross sectional study," Allergy Asthma Clin Immunol., 2016;12:10.

Gokden et al.: Diagnostic utility of renal cell carcinoma marker in cytopathology. Appl Immunohistochem Mol Morphol. Abstract Only. 11(2):116-119 doi:10.1097/00129039-200306000-00004 (2003).

Gordon, E.D. et al., "Alternative splicing of interleukin-33 and type 2 inflammation in asthma," PNAS, 2016;113(31):8765-8770.

Gram, H. et al., In vitro selection and affinity maturation of antibodies from a naïve combinatorial immunoglobulin library, PNAS, 1992, vol. 89, pp. 3576-3580.

Green, Edward, et al., TCR Validation Toward Gene Therapy for Cancer. Methods in Enzymology 629(21):419-441 (2019).

Green, L.L. et al., "Antigen-specific human monoclonal antibodies from mice engineered with human Ig heavy and light chain YACS", Nature Genet, 1994, vol. 7, pp. 13-21.

Griffiths, A.D. et al., "Human anti-self antibodies with high specificity from phage display libraries", The EMBO Journal, 1993, vol. 12, No. 2, pp. 725-734.

Gulley, J.L. et al., "New drugs on the horizon," Eur J Cancer, 2022;174(S1):S5.

Gupta, S. et al., "T cell activation via the T cell receptor: a comparison between WT31 (defining alpha/beta TcR)-induced and anti-CD3-induced activation of human T lymphocytes," Cell Immunol., 1991;132(1):26-44.

Haanen, J. et al., "Selective Expansion of Cross-reactive CD8+ Memory T Cells by Viral Variants", J. Exp. Med., 1999, vol. 190, No. 9, pp. 1319-1328.

(56) References Cited

OTHER PUBLICATIONS

Hacken, Elisa, et al., Calreticulin as a Novel B-Cell Receptor Antigen in Chronic Lymphocytic Leukemia. Haematologica 102(10):e394-e396 (2017).
Halin, C. et al., "Synergistic Therapeutic Effects of a Tumor Targeting Antibody Fragment, Fused to Interleukin 12 and to Tumor Necrosis Factor a1," Cancer Research, 2003;63:3202-3210.
Hall, MacLean, et al., Expansion of Tumor-Infiltrating Lymphocytes (TIL) from Human Pancreatic Tumors. Journal for Immuno Therapy of Cancer 4:61, 1-12 (2016).
Hamid, O. et al., "Safety and Tumor Responses with Lambrolizumab (Anti-PD-1) in Melanoma", The New England Journal of Medicine, 2013, vol. 369, No. 2, pp. 134-144.
Hamming et al. Crystal Structure of Interleukin-21 Receptor (IL-21R) Bound to IL-21 Reveals That Sugar Chain Interacting with WSXWS Motif Is Integral Part of IL-21R. The Journal of Biological Chemistry 287(12):9454-9460 (2012).
Hawkins, R. et al., "Selection of phage antibodies by binding affinity. Mimicking affinity maturation", J. Mol. Biol., 1992, vol. 226, No. 3, pp. 889-896.
Hay, B. et al., "Bacteriophage cloning and *Escherichia coli* expression of a human lgM Fab" Hum Antibodies Hybridomas, 1992, vol. 3, No. 2, pp. 81-85.
Henderson, D J, et al., Comparison of the Effects of FK-506, Cyclosporin A and Rapamycin on IL-2 Production. Immunology 73(3):316-321 (1991).
Herskovitz, O. et al., "NKp44 receptor mediates interaction of the envelope glycoproteins from the West-Nile and dengue viruses with Natural Killer cells," The Journal of Immunology, 2009;183(4):2610-2621.
Hirai et al.: Nucleolar scaffold protein, WDR46, determines the granular compartmental localization of nucleolin and DDX21. Genes Cells 18(9):780-797 (2013).
Hiyama, K, et al., Action of Chondroitinases. I. The Mode of Action of Two Chondroitinase-AC Preparations of Different Origin. Journal of Biochemistry 80(6):1201-1207 (1976).
Hiyama, K, et al., Crystallization and Some Properties of Chondroitinase from Arthrobacter Aurescens. The Journal of Biological Chemistry 250(5):1824-1828 (1975).
Hollinger, Philipp, et al., Engineered Antibody Fragments and the Rise of Single Domains. Nature Biotechnology 23(9):1126-1136 (2005).
Hombach, A.A. et al., "Antibody-IL2 Fusion Proteins for Tumor Targeting," Antibody Engineering, 2012:611-626.
Hoogenboom, H.R. et al., "Multi-subunit proteins on the surface of filamentous phage: methodologies for displaying antibody (Fab) heavy and light chains", Nuc Acid Res, 1991, vol. 19, No. 15, pp. 4133-4137.
Howard, M A, et al., Intracerebral Drug Delivery in Rats with Lesion-induced Memory Deficits. Journal of Neurosurgery 71(1):105-112 (1989).
Hudson, K.R. et al., "Two Adjacent Residues in *Staphylococcal* EnterotoxIns A and E Determine T Cell Receptor Vbeta Specificity," J.Exp. Med., 1993;177:175-184.
Hudspeth et al.: Natural cytotoxicity receptors: broader expression patterns and functions in innate and adaptive immune cells. Frontiers in Immunology 4(69):1-15 (2013).
Hunig, T. et al., "A monoclonal antibody to a constant determinant of the rat t cell antigen receptor that induces t cell activation", J. Exp. Med., 1989, vol. 169, pp. 73-86.
Huse, W. et al., "Generation of a large combinatorial library of the immunoglobulin repertoire in phage lambda" Science, 1989, vol. 246, No. 4935, pp. 1275-1281.
Huston, James, et al., Protein Engineering of Antibody Binding Sites: Recovery of Specific Activity in an Anti-digoxin Single-chain Fv Analogue Produced in *Escherichia coli*. Proceedings of the National Academy of Sciences of the United States of America 85(16):5879-5883 (1988).
International Preliminary Report on Patentability issued in PCT/US2017/023483, dated Sep. 25, 2018.
International Preliminary Report on Patentability issued in PCT/US2019/040592, dated Jan. 5, 2021.
International Preliminary Report on Patentability issued in PCT/US2020/012162, dated Jun. 16, 2021.
International Preliminary Report on Patentability issued in PCT/US2020/019291, dated Aug. 10, 2021.
International Preliminary Report on Patentability issued in PCT/US2020/019319, dated Aug. 10, 2021.
International Preliminary Report on Patentability issued in PCT/US2020/019321, dated Aug. 10, 2021.
International Preliminary Report on Patentability issued in PCT/US2020/060557 dated May 17, 2022.
International Preliminary Report on Patentability issued in PCT/US/2020/067543, dated Jul. 5, 2022.
International Preliminary Report on Patentability issued in PCT/US2021/022408, dated Sep. 20, 2022.
International Preliminary Report on Patentability issued in PCT/US2021/028970, dated Oct. 25, 2022.
International Search Report and Written Opinion for corresponding PCT Application No. PCT/US2019/022282 issued Jul. 1, 2019.
International Search Report and Written Opinion issued in PCT/US2017/023483, mailed Aug. 29, 2017.
International Search Report and Written Opinion issued in PCT/US2019/040592, mailed Jan. 9, 2020.
International Search Report and Written Opinion issued in PCT/US2020/012162 mailed Jun. 26, 2020.
International Search Report and Written Opinion issued in PCT/US2020/019291, mailed Jun. 15, 2020.
International Search Report and Written Opinion issued in PCT/US2020/019319, mailed Jun. 26, 2020.
International Search Report and Written Opinion issued in PCT/US2020/019321, mailed Aug. 10, 2020.
International Search Report and Written Opinion issued in PCT/US2020/060557, mailed Mar. 30, 2021.
International Search Report and Written Opinion issued in PCT/US2020/067543, mailed Jul. 7, 2021.
International Search Report and Written Opinion issued in PCT/US2021/022408, mailed Aug. 31, 2021.
International Search Report and Written Opinion issued in PCT/US2021/028970 mailed Oct. 4, 2021.
International Search Report and Written Opinion issued in PCT/US2021/047571, dated Feb. 14, 2022.
International Search Report and Written Opinion issued in PCT/US2022/023922, mailed Oct. 17, 2022.
Islam, D, et al., Changes in the Peripheral Blood T-Cell Receptor V Beta Repertoire in Vivo and in Vitro During Shigellosis. Infection and Immunity 64(4):1391-1399 (1996).
Jameson, Stephen C., "T cell receptor antagonism in vivo, at last", Proc. Natl. Acad. Sci., 1998, vol. 95, pp. 14001-14002.
Jiang, B. et al., "A novel peptide isolated from a phage display peptide library with trastuzumab can mimic antigen epitope of HER-2*," The Journal of Biological Chemistry, 2005;280(6):4656-4662.
Jiang et al.: Nuclear expression of CDK4 correlates with disease progression and poor prognosis in human nasopharyngeal carcinoma. Histopathology 64(5):722-730 doi:10.1111/his.12319 (2013).
Jones et al., Replacing The Complementarity-determining Regions in a Human Antibody With Those From a Mouse. Nature 321(6069):522-525 (1986).
Ju et al.: Structure-function analysis of human interleukin-2. Identification of amino acid residues required for biological activity. The Journal of Biological Chemistry 262(12):5723-5731 (1987).
Kanagawa, et al., "In Vivo T Cell Tumor Therapy With Monoclonal Antibody Directed to the VB chain of T Cell Antigen Receptor" J. Exp. Med., vol. 170, (1989) p. 1513-1519.
Kanagawa, O, et al., The T Cell Receptor VB6 Domain Imparts Reactivity to the Mls-1a Antigen. Cellular Immunology 119(2):412-426 (1989).
Kato et al.: The structure and binding mode of interleukin-18. Nature Structural Biology 10(11):366-971 (2003).

(56) References Cited

OTHER PUBLICATIONS

Kato, Y. et al., "Molecular analysis of the pathophysiological binding of the platelet aggregation-inducing factor podoplanin to the C-type lectin-like receptor CLEC-2", Cancer Sci, Jan. 2008, vol. 99, No. 1, pp. 54-61.
Kawaguchi, M, et al., Differential Activation Through the TCR-CD3 Complex Affects the Requirement for Costimulation of Human T Cells. Human immunology 43(2):136-148 (1995).
Kellner et al.: Enhancing natural killer cell-mediated lysis of lymphoma cells by combining therapeutic antibodies with CD20-specific immunoligands engaging NKG2D or NKp30. Oncoimmunology 5(1)e1058459 [1-12] (2016).
Kerkela, E, et al., Expression of Human Macrophage Metalloelastase (MMP-12) by Tumor Cells in Skin Cancer. Journal of Investigative Dermatology 114(6):1113-1119 (2000).
Kiefer, J.D. et al., "Immunocytokines and bispecific antibodies: two complementary strategies for the selective activation of immune cells at the tumor site," Immunol Rev., 2016;270(1):178-192.
Kim, E.J. et al., "Interleukin-2 fusion protein with anti-CD3 single-chain Fv (sFv) selectively protects T cells from dexamethasone-induced apoptosis," Vaccine, 2002;20:608-615.
Kirkin, et al. Melanoma-associated antigens recognized by cytotoxic T lymphocytes. APMIS. Jul. 1998;106(7):665-79.
Kitaura, K. et al., "A new high-throughput sequencing method for determining diversity and similarity of T cell receptor (TCR) α and β repertoires and identifying potential new invariant TCR α chains," BMC Immunology, 2016, vol. 17, No. 38, pp. 1-16.
Klampfl, T. et al., "Somatic Mutations of Calreticulin in Myeloproliferative Neoplasms", N Engl J Med., 2013, vol. 369, No. 25, pp. 2379-2390.
Klein, Christian, et al., Progress in Overcoming the Chain Association Issue in Bispecific Heterodimeric IgG Antibodies. mAbs 4(6):653-663 (2012).
Koch et al.: Activating natural cytotoxicity receptors of natural killer cells in cancer and infection. Trends Immunol. 34(4):182-191 doi:10.1016/j.it.2013.01.003 (2013).
Kunkel, Thomas A., "Rapid and efficient site-specific mutagenesis without phenotypic selection", Proc Natl Acad Sci, 1985, vol. 82, No. 2, pp. 488-492.
Kushner et al.: Aberrant expression of cyclin A and cyclin B1 proteins in oral carcinoma. J Oral Pathol Med. 28(2):77-81 (1999).
Labrijn, Aran, et al., Controlled Fab-arm Exchange for the Generation of Stable Bispecific IgG1. Nature Protocols 9(10):2450-2463 (2014).
Labrijn, Aran, et al., Efficient Generation of Stable Bispecific IgG1 by Controlled Fab-arm Exchange. Proceedings of the National Academy of Sciences of the United States of America 110(13):5145-5150 (2013).
Lain et al.: Accumulating active p53 in the nucleus by inhibition of nuclear export: a novel strategy to promote the p53 tumor suppressor function. Exp Cell Res. 253(2):315-324 (1999).
Langer, Robert, et al., Chemical and Physical Structure of Polymers as Carriers for Controlled Release of Bioactive Agents: A Review. Journal of Macromolecular Science-Reviews in Macromolecular Chemistry and Physics 23(1):61-126 (1983).
Langer, Robert, et al., Medical Applications of Controlled Release. 2:115-138 (1984).
Langer, Robert, New Methods of Drug Delivery. Science 249(4976):1527-1533 (1990).
Lanier, L.L. et al., "Distinct epitopes on the t cell antigen receptor of HPB-ALL tumor cells identified by monoclonal antibodies," 1986;137(7):2286-2292.
Leclercq, G. et al., "Dissecting the mechanism of cytokine release induced by T-cell engagers highlights the contribution of neutrophils," Oncoimmunology, 2022;11(1):e2039432.
Lee, C. M. et al., "Selection of human antibody fragments by phage display", Nat Protoc., 2007, vol. 2, No. 11, pp. 3001-3008.
Lee, K.D. et al., "Construction and characterization of a novel fusion protein consisting of anti-CD3 antibody fused to recombinant interleukin-2," Oncology Reports, 2006;15:1211-1216.

Leonard, E.K. et al., "Engineered cytokine/antibody fusion proteins improve delivery of IL-2 to pro-inflammatory cells and promote antitumor activity," bioRxiv, 2023:1-36.
Leong et al.: Optimized expression and specific activity of IL-12 by directed molecular evolution. Proc. Natl. Acad. Sci. USA; 100(3): 1163-1168 (2003).
Leutkens et al.: Functional autoantibodies against SSX-2 and NY-ESO-1 in multiple myeloma patients after allogeneic stem cell transplantation. Cancer Immunol Immunother. 63(11):1151-1162 (2014).
Levy, R J, et al., Inhibition of Calcification of Bioprosthetic Heart Valves by Local Controlled-Release Diphosphonate. Science 228(4696):190-192 (1985).
Li, B. et al., "Landscape of tumor-infiltrating T cell repertoire of human cancers," Nature Genetics, 2016, vol. 48, No. 7, pp. 725-735.
Li, F. et al., "T cell receptor B-chain-targeting chimeric antigen receptor T cells against T cell malignancies," Nature Communications, 2022;13:4334.
Li, Hanchen, et al., Tumor Microenvironment: The Role of the Tumor Stroma in Cancer. Journal of Cellular Biochemistry 101(4):805-815 (2007).
Li, Peng, et al., Design and Synthesis of Paclitaxel Conjugated with an ErbB2-recognizing Peptide, EC-1. Biopolymers 87(4):225-230 (2007).
Liddy et al.: Monoclonal TCR-redirected tumor cell killing. Nat Med. 18(6):980-987 doi:10.1038/nm.2764 (2012).
Liu, Alvin, et al., Chimeric Mouse-human IgG1 Antibody that can Mediate Lysis of Cancer Cells. Proceedings of the National Academy of Sciences of the United States of America 84(10):3439-3443 (1987).
Liu, Alvin, et al., Production of a Mouse-human Chimeric Monoclonal Antibody to CD20 With Potent Fc-dependent Biologic Activity. Journal of Immunology 139(10):3521-3526 (1987).
Liu, Der-Zen, et al., Synthesis of 2'-paclitaxel Methyl 2-glucopyranosyl Succinate for Specific Targeted Delivery to Cancer Cells. Bioorganic & Medicinal Chemistry Letters 17(3):617-620 (2007).
Liu, D.V. et al., "Engineered Interleukin-2 Antagonists for the Inhibition of Regulatory T Cells," J. Immunother., 2009;32(9):887-894.
Liu, Hongyan, et al., Fc Engineering for Developing Therapeutic Bispecific Antibodies and Novel Scaffolds. Frontiers in Immunology 8(38) 1-15 (2017).
Liu, J, et al., Calcineurin is a Common Target of Cyclophilin-Cyclosporin A and FKBP-FK506 Complexes. Cell 66(4):807-815 (1991).
Liu, K. et al., "CD123 and its potential clinical application in leukemias," Life Sciences, 2015;122:59-64.
Lloyd et al., Modelling the Human Immune Response: Performance of a 10' Human Antibody Repertoire Against a Broad Panel of Therapeutically Relevant Antigens. Protein Engineering Design & Selection. 22(3):159-168 (2009).
Lobuglio, Albert, et al., Phase I Clinical Trial of CO17-1A Monoclonal Antibody. Hybridomia 5(1):S117-S123 (1986).
Lonberg, Nils, et al., Antigen-Specific Human Antibodies From Mice Comprising Four Distinct Genetic Modifications. Nature 368(6474):856-859 (1994).
Luo, S. et al., "Worldwide genetic variation of the IGHV and TRBV immune receptor gene families in humans" (2019) Life Sciences Alliance, vol. 2, No. 2, p. 1-9.
Lustgarten, J. et al., "Redirecting Effector T Cells through their IL-2 receptors," J Immunology, 1999;162:359-365.
Maciocia, P. M. et al., "Targeting the T cell receptor β-chain constant region for immunotherapy of T cell malignancies", Nature Medicine, 2017, vol. 23, No. 12, pp. 1416-1423.
MacKay, C.R. et al., "Gamma/delta T cells express a unique surface molecule appearing late during thymic development," Eur J Immunol., 1989;19(8):1477-1483.
Macor, P. et al., "Bispecific antibodies targeting tumor-associated antigens and neutralizing complement regulators increase the efficacy of antibody-based immunotherapy in mice", Leukemia, 2015, vol. 29, pp. 406-414.

(56) References Cited

OTHER PUBLICATIONS

Mandelboim, O. et al., "Recognition of hemagglutinins on virus-infected cells by NKp46 activates lysis by human NK cells", Nature, 2001, vol. 409, No. 6823, pp. 1055-1060.
Mao et al.: Inhibition of human natural killer cell activity by influenza virions and hemagglutinin. Journal of Virology 84(9 ):4148-4157 (2010).
Martens, Tobias, et al., A Novel One-Armed Anti-c-Met Antibody Inhibits Glioblastoma Growth in Vivo. Clinical Cancer Research 12(20 Pt 1):6144-6152 (2006).
Martin, A. et al., "Chapter 3: Protein Sequence and Structure Analysis of Antibody Variable Domains", In: Antibody Engineering Lab Manual (Ed: Duebel, S. and Kontermann, R., Springer-Verlag, Heidelberg), 2010, vol. 2, pp. 33-51.
Martin, F. et al., "The affinity-selection of a minibody polypeptide inhibitor of human interleukin-6", EMBO J., 1994, vol. 13, No. 22, pp. 5303-5309.
McConnell, Stephen, et al., Tendamistat as a Scaffold for Conformationally Constrained Phage Peptide Libraries. Journal of Molecular Biology 250(4):460-470 (1995).
McElroy et al.: Structural and Biophysical Studies of the Human IL-7/IL-7R alpha Complex. Structure 17(1):54-65 (2009).
Merchant, A.M. et al., "An efficient route to human bispecific lgG," Nature Biotechnology, 1998;16(7):677-681.
Meschendoerfer, W. et al., "SPR-based assays enable the full functional analysis of bispecific molecules," Journal of Pharmaceutical and Biomedical Analysis, 2017, vol. 5, No. 132, pp. 141-147.
Meyers, E. et al., "Optimal alignments in linear space", CABIOS,1988, vol. 4, No. 1, pp. 11-17.
Michelacci, Y M, et al., A Comparative Study Between a Chondroitinase B and a Chondroitinase AC From Flavobacterium Heparinum: Isolation of a Chondroitinase AC-Susceptible Dodecasaccharide From Chondroitin Sulphate B. The Biochemical Journal 151(1):121-129 (1975).
Michelacci, Yara, et al., Isolation and Partial Characterization of an Induced Chondroitinase B from Flavobacterium Heparinum. Biochemical and Biophysical Research Communications 56(4):973-980 (1974).
Miller et al.: Trispecific Killer Engagers (TrikEs) that contain IL-15 to make NK cells antigen specific and to sustain their persistence and expansion. Blood 126(23):232-232 (2015).
Milone, Michael, et al., Chimeric Receptors Containing CD137 Signal Transduction Domains Mediate Enhanced Survival of T Cells and Increased Antileukemic Efficacy in Vivo. Molecular Therapy 17(8):1453-1464 (2009).
Mitra, S. et al., "Interleukin-2 Activity can be Fine-Tuned with Engineering Receptor Signaling Clamps," Immunity, 2015;42(5):826-838.
Miyahara, Y et al., Anti-TCRB mAb induces long-term allograft survival by reducing antigen-reactive T cells and sparing regulatory T cells, American journal of transplantation: official Journal of the American Society of Transplantation and the American Society of Transplant Surgeons, vol. 12, 6 (2012):1409-18.
Modak et al.: Disialoganglioside GD2 and a novel tumor antigen: potential targets for immunotherapy of desmoplastic small round cell tumor. Med Pediatr Oncol. 39(6):547-551 (2002).
Moore, Gregory, et al., A Novel Bispecific Antibody Format Enables Simultaneous Bivalent and Monovalent Co-engagement of Distinct Target Antigens. mAbs 3(6):546-557 (2011).
Morel et al.: Processing of some antigens by the standard proteasome but not by the immunoproteasome results in poor presentation by dendritic cells. Immunity. 12(1):107-117 doi:10.1016/s1074-7613(00)80163-6 (2000).
Morrison, Sherie, et al., Chimeric Human Antibody Molecules: Mouse Antigen-binding Domains With Human Constant Region Domains. Proceedings of the National Academy of Sciences of the United States of America 81(21):6851-6855 (1984).
Morrison, Sherie, Transfectomas Provide Novel Chimeric Antibodies. Science 229(4719):1202-1207 (1985).
Muller, K P, et al., T Cell Receptor Targeting to Thymic Cortical Epithelial Cells in Vivo Induces Survival, Activation and Differentiation of Immature Thymocytes. European Journal of Immunology 23(7):1661-1670 (1993).
Murer, P. et al., "Antibody-cytokine fusion proteins: A novel class of biopharmaceuticals for the therapy of cancer and of chronic inflammation", New Biotechnology, 2019, vol. 52, pp. 42-53.
Murzin, A G, et al., SCOP: A Structural Classification of Proteins Database for the Investigation of Sequences and Structures. Journal of Molecular Biology 247(4):536-540 (1995).
Nagarajan et al.: Ligand binding and phagocytosis by CD16 (Fc gamma receptor III) isoforms. Phagocytic signaling by associated zeta and gamma subunits in Chinese hamster ovary cells. Journal of Biological Chemistry J Biol Chem. 270(43):25762-25770 (1995).
Naing, et al., "Strategies for improving the management of immune-related adverse events" Journal for Immuno Therapy of Cancer, (2020) p. 1-9.
Nandi et al.: CD28-mediated costimulation is necessary for optimal proliferation of murine NK cells. J Immunol. 152(7):3361-3369 (1994).
Nangalia, J. et al., "Somatic CALR Mutations in Myeloproliferative Neoplasms with Nonmutated JAK2", N Engl J Med., 2013, vol. 369, No. 25, pp. 2391-2405.
Needleman, Saul B, et al., A General Method Applicable to the Search for Similarities in the Amino Acid Sequence of Two Proteins. Journal of Molecular Biology 48(3):443-453 (1970).
Newman et al.: Combining Early Heat Shock Protein Vaccination with Directed IL-2 Leads to Effective Anti-Tumor Immunity in Autologous Hematopoietic Cell Transplantation Recipients. 118(21):998-998 (2011).
Niederberger, N. et al., "Thymocyte stimulation by anti-TCR-b, but not by anti-TCR-a, leads to induction of developmental transcription program," Journal of Leukoeyte Biology, 2005;77(5):830-841.
Nishimura, Yushi, et al., Recombinant Human-Mouse Chimeric Monoclonal Antibody Specific for Common Acute Lymphocytic Leukemia Antigen. Cancer Research 47(4):999-1005 (1987).
No Author "Pe anti-human TCR VB23 Antibody" (2012).
No Author "Pe anti-mouse TCR VB6 Antibody" (2012).
Nolo, R. et al., "Targeting P-selection blocks neuroblastoma growth", Oncotarget, 2017, vol. 8, No. 49, pp. 86657-86670.
Novellino et al.: A listing of human tumor antigens recognized by T cells: Mar. 2004 update. Cancer Immunol Immunother. 54(3):187-207 doi:10.1007/s00262-004-0560-6 (2005).
Oh, Julyun, et al., Single Variable Domains From the T Cell Receptor B Chain Function as Mono- and Bifunctional CARs and TCRs. Scientific Reports 9(1):17291, 1-12 (2019).
Ol, Vernon, et al., Chimeric Antibodies. BioTechniques 4(3):214-221 (1986).
Ortiz-Sanchez, Elizabeth, et al., Antibody-Cytokine Fusion Proteins: Applications in Cancer Therapy. Expert Opinion on Biological Therapy 8(5):609-632 (2008).
Page, David, et al., Deep Sequencing of T-cell Receptor DNA as a Biomarker of Clonally Expanded TILs in Breast Cancer after Immunotherapy. Cancer Immunology Research 4(10):835-844 (2016).
Pardoll, D.M., "The blockade of immune checkpoints in cancer immunotherapy", Nat Rev Cancer, 2012, Vo. 12, pp. 252-264.
Park, Y.P. et al., "Complex Regulation of human NKG2D-DAP10 cell surface expression: opposing roles of the γc cytokines and TGF-β1", Blood, 2011, vol. 118, No. 11, pp. 3019-3027.
Pasche, N. et al., "Immunocytokines: a novel class of potent armed antibodies," Drug Discovery Today, 2012;17(11):583-590.
Paul, S. et al., "TCR beta chain-directed bispecific antibodies for the treatment of T-cell cancers," Science Translational Medicine, 2021, pp. 1-21.
Payne, J. et al., "Two Monoclonal Rat Antibodies with Specificity for the β-Chain Variable Region Vβ6 of the Murine T-Cell Receptor", Proc. Natl. Acad. Sci., 1988, vol. 85, pp. 7695-7698.
PCT/US2018/029951 International Preliminary Report on Patentability dated Oct. 29, 2019.
PCT/US2018/029951 International Search Report and Written Opinion dated Mar. 7, 2018.
PCT/US2019/012900 International Search Report and Written Opinion dated May 7, 2019.

(56) References Cited

OTHER PUBLICATIONS

PCT/US2019/022284 International Preliminary Report on Patentability dated Sep. 15, 2020.
PCT/US2019/022284 International Search Report and Written Opinion dated Sep. 10, 2019.
PCT/US2020/019324 International Preliminary Report on Patentability dated Aug. 10, 2021.
PCT/US2020/019324 International Search Report and Written Opinion dated Jun. 10, 2020.
Pettit et al.: Structure-function studies of interleukin 15 using site-specific mutagenesis, polyethylene glycol conjugation, and homology modeling. J Biol Chem. 272(4):2312-2318 (1997).
Pilch, H, et al., Improved Assessment of T-Cell Receptor (TCR) VB Repertoire in Clinical Specimens: Combination of TCR-CDR3 Spectratyping with Flow Cytometry-Based TCR VB Frequency Analysis. Clinical and Diagnostic Laboratory Immunology 9(2):257-266 (2002).
Posnett, D.N. et al., "Inherited polymorphism of the human T-cell antigen receptor detected by a monoclonal antibody," PNAS, 1986;83:7888-7892.
Presta, Leonard, Antibody Engineering. Current Opinion in Structural Biology 2(4):593-596 (1992).
Provenzano et al.: Enzymatic targeting of the stroma ablates physical barriers to treatment of pancreatic ductal adenocarcinoma. Cancer Cell. 21(3):418-429 doi:10.1016/j.ccr.2012.01.007 (2012).
Qi, et al., "Potent and selective antitumor activity of a T cell-engaging bispecific antibody targeting a membrane-proximal epitope of ROR1," PNAS, 2018;115(24):E5467-E5476.
Rabia, L. et al., "Understanding and overcoming trade-offs between antibody affinity, specificity, stability and solubility," Biochemical Engineering Journal, 2018;137:365-374.
Rakoff-Nahoum, Seth, et al., Toll-like Receptors and Cancer. Nature Reviews Cancer 9(1):57-63 (2009).
Rath, et al., "Engineering Strategies to Enhance TCR-Based Adoptive T Cell Therapy" (2020) Cells, 9, 1485, p. 1-34.
Reiter, Yoram, et al., Antibody Engineering of Recombinant Fv Immunotoxins for Improved Targeting of Cancer: Disulfide-stabilized Fv Immunotoxins. Clin Cancer Res 2(2):245-252 (1996).
Ridgway, John, et al., Knobs-Into-Holes Engineering of Antibody CH3 Domains for Heavy Chain Heterodimerization. Protein Engineering 9(7):617-621 (1996).
Riechmann, L, et al., Reshaping Human Antibodies for Therapy. Nature 332(6162):323-327 (1988).
Riemer, A.B. et al., "Matching of trastuzumab (Herceptin) epitope mimics onto the surface of Her-2/neu—a new method of epitope definition," Molecular Immunology, 2005;42:1121-1124.
Ring et al.: Mechanistic and structural insight into the functional dichotomy between interleukin-2 and interleukin-15. Nat Immunol. 13(12):1187-1195 (2012).
Roda-Navarro, P. et al., "Understanding the Spatial Topology of Artificial Immunology Synapses Assembled in T Cell-Redirecting Strategies: A Major Issue in Cancer Immunotherapy", Frontiers in Cell and Developmental Biology, 2020, vol. 7, No. 370.
Rohena-Rivera et al.: IL-15 regulates migration, invasion, angiogenesis and genes associated with lipid metabolism and inflammation in prostate cancer. PloS one 12(4):e0172786:1-27 (2017).
Rosenberg, Steven, et al., Use of Tumor-Infiltrating Lymphocytes and Interleukin-2 in the Immunotherapy of Patients with Metastatic Melanoma. The New England Journal of Medicine 319(25):1676-1680 (1988).
Rudikoff et al.: Single Amino Acid Substitution Altering Antigen-binding Specificity. PNAS USA 79(6):1979-1983 (1982).
Ruggiero, Eliana, et al., High-resolution Analysis of the Human T-Cell Receptor Repertoire. Nature Communication 6:8081, 1-7 (2014).
Salameire, et al., "Accurate detection of the tumor clone in peripheral T-cell lymphoma biopsies by flow cytometric analysis of TCR-V B repertoire" Modern Pathology (2012) 25, p. 1246-1257.
Saleh, Mansoor, et al., A Phase II Trial of Murine Monoclonal Antibody 17-1A and Interferon-gamma: Clinical and Immunological Data. Cancer Immunology, Immunotherapy 32(3):185-190 (1990).
Sano, Y. et al., "Properties of Blocking and Non-blocking Monoclonal Antibodies Specific for Human Macrophage Galactose-type C-type Lectin (MGL/ClecSF10A/CD301)," J. Biochem., 2007;127-136.
Sastry, Konduru, et al., Targeting Hepatitis B virus-infected cells with a T-Cell Receptor-like Antibody. Journal of Virology 85(5):1935-1942 (2011).
Saudek et al. A preliminary trial of the programmable implantable medication system for insulin delivery. N. Engl. J. Med. 321(9):574-579 (1989).
Saunders, Kevin, Conceptual Approaches to Modulating Antibody Effector Functions and Circulation Half-Life. Frontiers in Immunology 10:1296, 1-20 (2019).
Schleinitz, N. et al., "Natural killer cells in human autoimmune diseases," Immunology, 2010;131(4):451-458.
Schliemann et al.: Targeting interleukin-2 to the bone marrow stroma for therapy of acute myeloid leukemia relapsing after allogeneic hematopoietic stem cell transplantation. Cancer immunology research 3(5):547-556 (2015).
Schmittnaegel, Martina, et al., Activation of Cytomegalovirus-Specific CD8+ T-cell response by Antibody-Mediated peptide-major Histocompatibility class I Complexes. OncoImmunology 5(1):e1052930, 1-3 (2015).
Scodeller, Pablo, Hyaluronidase and Other Extracellular Matrix Degrading Enzymes for Cancer Therapy: New Uses and Nano-Formulations, Journal of Carcinogenesis & Mutagenesis 5(4):1-5 (2014).
Sefton, Michael, Implantable Pumps. Critical Reviews in Biomedical Engineering 14(3):201-240 (1987).
Seidel, U. et al., "Natural killer cell mediated antibody-dependent cellular cytotoxicity in tumor immunotherapy with therapeutic antibodies", frontiers in Immunology, 2013, vol. 4, No. 76, pp. 1-8.
Sekine, T. et al., "A feasible method for expansion of peripheral blood lymphocytes by culture with immobilized anti-CD3 monoclonal antibody and interleukin-2 for use in adoptive immunotherapy of cancer patients," Biomed & Pharmacother, 1993;47:73-78.
Sen, S. et al., "Expression of epithelial cell adhesion molecule (EpCAM) in oral squamous cell carcinoma," Histopathology, 2015:6:897-904. Abstract only.
Sergeeva, Anna, et al., An Anti-PR1/HLA-A2 T-cell Receptor-like Antibody Mediates Complement-Dependent Cytotoxicity Against Acute Myeloid Leukemia Progenitor Cells. Blood 117(16):4262-4272 (2011).
Shaw, Denise, et al., Mouse/Human Chimeric Antibodies to a Tumor-Associated Antigen: Biologic Activity of the Four Human IgG Subclasses. Journal of the National Cancer Institute 80(19):1553-1559 (1988).
Shi, M. et al., "A recombinant anti-erbB2, scFv-Fc-IL-2 fusion protein retains antigen specificity and cytokine function," Biotechnology letters, 2003;25:815-819.
Shimabukuro-Vornhagen, Alexander, et al., Cytokine Release Syndrome. Journal for Immuno Therapy of Cancer 6(56):1-14 (2018).
Shitaoka, Kiyomi, et al., Identification of Tumoricidal TCRs from Tumor-Infiltrating Lymphocytes by Single-Cell Analysis. Cancer Immunology Research 6(4):378-388 (2018).
Shpilberg, O, et al., Subcutaneous Administration of Rituximab (MabThera) and Trastuzumab (Herceptin) using Hyaluronidase. British Journal of Cancer 109(6):1556-1561 (2013).
Skegro, D. et al., "Immunoglobulin domain interface exchange as a platform technology for the generation of Fc heterodimers and bispecific antibodies," J Biol Chem, 2017, vol. 292, No. 23, pp. 9745-9759.
Spiess, C. et al., "Alternative molecular formats and therapeutic applications for bispecific antibodies", Molecular Immunology, 2015, vol. 67, pp. 95-106.
Stauber, D.J. et al., "Crystal structure of the IL-2 signaling complex: Paradigm for a heterotrimeric cytokine receptor," PNAS, 2006;103(8):2788-2793.

(56) References Cited

OTHER PUBLICATIONS

Stauber et al.: Nuclear and cytoplasmic survivin: molecular mechanism, prognostic, and therapeutic potential. Cancer Res. 67(13):5999-6002 (2007).
Stein, H, et al., A New Monoclonal Antibody (CAL2) Detects Calreticulin Mutations in Formalin-fixed and Paraffin-embedded Bone Marrow Biopsies. Leukemia 30(1):131-135 (2016).
Stivala, Alex, et al., Automatic Generation of Protein Structure Cartoons With Pro-origami. Bioinformatics 27(23):3315-3316 (2011).
Sun, Lee, et al., Chimeric Antibody With Human Constant Regions and Mouse Variable Regions Directed Against Carcinoma-Associated Antigen 17-1A. Proceedings of the National Academy of Sciences of the United States of America 84(1):214-218 (1987).
Suzuki, Sakaru, et al., Formation of Three Types of Disulfated Disaccharides from Chondroitin Sulfates by Chondroitinase Digestion. The Journal of Biological Chemistry 243(7):1543-1550 (1968).
Swencki-Underwood, B. et al., "Engineering human IL-18 with increased bioactivity and bioavailability," Cytokine, 2006, vol. 34, pp. 114-124.
Tang, et al., "Anti-TCR Antibody Treatment Activates a Novel Population of Nonintestinal CD8aa+TCRaB+ Regulatory T Cells and Prevents Experimental Autoimmune Encephalomyelitis" The Journal of Immunology (2007) p. 1-9.
Tassev, D V, et al., Retargeting NK92 Cells using an HLA-A2-Restricted, EBNA3C-Specific Chimeric Antigen Receptor. Cancer Gene Ther 19(2):84-100 (2012).
Thorpe, Philip, Vascular Targeting Agents as Cancer Therapeutics. Clinical Cancer Research 10(2):415-427 (2004).
Tomlinson, Ian, et al., The Repertoire of Human Germline VH Sequences Reveals About Fifty Groups of VH Segments With Different Hypervariable Loops. Journal of Molecular Biology 227(3):776-798 (1992).
Tomonari, K. et al., "Epitope-specific binding of CD8 regulates activation of T cells and induction of cytotoxicity," International Immunology, 1990;2(12):1189-1194.
Tramontano et al.: The making of the minibody: an engineered beta-protein for the display of conformationally constrained peptides. J. Mol. Recognition. 7:9-24 (1994).
Trenevska et al.: Therapeutic Antibodies against Intracellular Tumor Antigens. Front Immunol. 8:1001 doi:10.3389/fimmu.2017.01001 [1-12] (2017).
Tsytsikov, V.N. et al., "Identification and Characterization of Two Alternative Splice Variants of Human Interleukin-2*" The Journal of Biological Chemistry, 1996;71(38):23055-23060.
Tuaillon, Nadine, et al., Human Immunoglobulin Heavy-Chain Minilocus Recombination in Transgenic Mice: Gene-Segment Use in Mu and Gamma Transcripts. Proceedings of the National Academy of Sciences of the United States of America 90(8):3720-3724 (1993).
U.S. Appl. No. 17/529,017 Non-Final Office Action dated Apr. 27, 2022.
Vallera et al.: Heterodimeric bispecific single-chain variable-fragment antibodies against EpCAM and CD16 induce effective antibody-dependent cellular cytotoxicity against human carcinoma cells. Cancer Biother Radiopharm. 28(4):274-282 doi:10.1089/cbr.2012.1329 (2013).
Vannucchi, et al., "Calreticulin mutation-specific immunostaining in myeloproliferative neoplasms: pathogenetic insight and diagnostic value" Leukemia (2014) 28, p. 1811-1818.
Verhoeyen, M. et al., "Reshaping Human Antibodies: Grafting an Antilysozyme Activity", Science, 1988, vol. 239, pp. 1534-1536.
Verma, Bhavna, et al., TCR Mimic Monoclonal Antibody Targets a Specific Peptide/HLA Class I Complex and Significantly Impedes Tumor Growth in Vivo Using Breast Cancer Models. J Immunol 184(4):2156-2165 (2010).
Verwilghen, J. et al., "Differences in the stimulating capacity of immobilized anti-CD3 monoclonal antibodies: variable dependence on interleukin-1 as a helper signal for T-cell activation," 1991;72:269-276.
Vonderheid, Eric, et al., Evidence for Restricted VB Usage in the Leukemic Phase of Cutaneous T Cell Lymphoma. The Journal of Investigative Dermatology 124(3):650-661 (2005).
Vyas, M. et al., "Natural ligands and antibody-based fusion proteins: harnessing the immune system against cancer", Trends in Molecular Medicine, 2014, vol. 20, No. 2, pp. 72-82.
Wadia, P. et al., "Impaired lymphocyte responses and their restoration in oral cancer patients expressing distinct TCR variable region," Cancer Investigation, 2008;26:471-480.
Wagner, E.K. et al., "Engineering therapeutics antibodies to combat infectious disease," Current Opinion in Chemical Engineering, 2018:19;131-141.
Wan, Y.Y. et al., "'Yin-Yang' functions of TGF-b and tregs in immune regulation," Immunol Rev., 2007;220:199-213.
Wang, Chun-Yan, et al., $\alpha\beta$ T-Cell Receptor Bias in Disease and Therapy (Review). International Journal of Oncology 48(6):2247-2256 (2016).
Wang et al.: Cloning genes encoding MHC class II-restricted antigens: mutated CDC27 as a tumor antigen. Science 284(5418):1351-1354 doi:10.1126/science.284.5418.1351 (1999).
Wang et al.: RNA interference targeting CML66, a novel tumor antigen, inhibits proliferation, invasion and metastasis of HeLa cells. Cancer Lett. 269(1):127-138 (2008).
Wang, H. et al., "Preparation and functional identification of a monoclonal antibody against the recombinant soluble human NKp30 receptor," Internal Immunopharmacology, 2011;11(11):1732-1739.
Warren, H.S. et al., "Evidence that the cellular ligand for the Human NK Cell Activation Receptor NKp30 is not a Heparan Sulfate Glycosaminoglycan," The Journal of Immunology, 2005;175(1):207-212.
Wei, Shan, et al., Identification of a Novel Human T-cell Receptor V$\beta$ Subfamily by Genomic Cloning. Human Immunology 41(3):201-206 (1994).
Weidle, U. et al., "The Intriguing Options of Multispecific Antibody Formats for Treatment of Cancer", Cancer Genomics & Proteomics, 2013, vol. 1, pp. 1-18.
Weidle, U.H. et al., "Tumor-Antigen-Binding Bispecific Antibodies for Cancer Treatment", Seminars in Oncology, 2014, vol. 41, No. 5, pp. 653-660.
Williemsen, R A, et al., A Phage Display Selected Fab Fragment with MHC Class I-Restricted Specificity for MAGE-A1 allows for Retargeting of Primary Human T Lymphocytes. Gene Therapy 8(21):1601-1608 (2001).
Wood, Clive, et al., The Synthesis and in Vivo Assembly of Functional Antibodies in Yeast. Nature 314(6010):446-449 (1985).
Wu, M.R. et al., "B7H6-Specific Bispecific T Cell Engagers Lead to Tumor Elimination and Host Antitumor Immunity", The Journal of Immunology, 2015, vol. 194, No. 11, pp. 5305-5311.
Wurzer et al.: Nuclear Ras: unexpected subcellular distribution of oncogenic forms.J Cell Biochem Suppl. Suppl 36:1-11 doi:10.1002/jcb.1070 (2001).
Xiao, Y.F. et al., "Peptide-based treatment: A promising cancer therapy", Journal of Immunology Research, 2015, pp. 1-14.
Xiaoying, C. et al., "Fusion protein linkers: Property, design and functionality", Advanced Drug Delivery Reviews, 2012, vol. 65, No. 10, pp. 1357-1369.
Xu, Xiao-Jun, et al., Cytokine Release Syndrome in Cancer Immunotherapy with Chimeric Antigen Receptor Engineered T Cells. Cancer Letters 343(2):172-178 (2014).
Yamagata, Tatsuya, et al., Purification and Properties of Bacterial Chondroitinases and Chondrosulfatases. The Journal of Biological Chemistry 243(7):1523-1535 (1968).
Yassai, Maryam, et al., A Clonotype Nomenclature for T Cell Receptors. Immunogenetics 61(7):493-502 (2009).
Yoon et al.: Charged residues dominate a unique interlocking topography in the heterodimeric cytokine interleukin-12. The EMBO J. 19(14):3530-3541 (2000).
Yoon, S.T. et al., "Both high and low avidity antibodies to the T cell receptor can have agonist or antagonist activity," Immunity, 1994;1(7):563-569.
Zhang, T. et al., "Cancer Immunotherapy Using a Bispecific NK Receptor Fusion Protein that Engages both T Cells and Tumor Cells", Cancer research, 2011, vol. 71, No. 6, pp. 2066-2076.

(56) References Cited

OTHER PUBLICATIONS

International Search Report and Written Opinion issued in PCT/US2019/040592, mailed Jan. 3, 2020.
PCT/US2018/029951 International Search Report and Written Opinion dated Jul. 3, 2018.
PCT/US2024/033300 International Search Report and Written Opinion dated Jan. 29, 2025.
U.S. Appl. No. 16/960,704 Corrected Notice of Allowability dated Dec. 20, 2024.
U.S. Appl. No. 17/584,892 Office Action dated Feb. 3, 2025.
U.S. Appl. No. 17/820,805 Notice of Allowance dated Jan. 24, 2025.
Agata, Yasutoshi. et al. Expression of the PD-1 Antigen on the Surface of Stimulated Mouse T and B Lymphocytes. International Immunology 8(5):765-772 (1996).
Aggen, DH. et al. Single-chain Vα Vβ T-cell Receptors Function Without Mispairing With Endogenous TCR Chains. Gene Therapy 19(4):365-374 (2012).
Akers, Michael J. et al. Formulation Development of Protein Dosage Forms. Pharmaceutical Biotechnology 14:47-127 (2002).
Akers, Michael J., et al. Peptides and proteins as parenteral solutions. Pharmaceutical formulation development of peptides and proteins. London: Taylor & Francis. pp. 145-77.(2000).
Allison, A C. The Mode of Action of Immunological Adjuvants. Developments in Biological Standardization 92:3-11 (1998).
Almagro et al.: Progress and Challenges in the Design and Clinical Development of Antibodies for Cancer Therapy. Frontiers in immunology; 8, 1751 (2018).
Almagro, Juan C, and Johan Fransson. Humanization of Antibodies. Frontiers in Bioscience 13:1619-1633 (2008).
Anderson, et al. Anti-CD3 + IL-2-stimulated murine killer cells. In vitro generation and in vivo antitumor activity. J Immunol 142 (4):1383-1394 (1989).
Baca, Manuel. et al. Antibody Humanization Using Monovalent Phage Display. The Journal of Biological Chemistry 272(16):10678-10684 (1997).
Barthelemy, Pierre A. et al. Comprehensive analysis of the factors contributing to the stability and solubility of autonomous human VH domains. The Journal of biological chemistry 283(6):3639-3654 (2008).
Batzer, Mark A. et al. Enhanced Evolutionary PCR Using Oligonucleotides With Inosine at the 3'-Terminus. Nucleic Acids Research 19(18):5081 (1991).
Baxter, et al. Acquired mutation of the tyrosine kinase JAK2 in human myeloproliferative disorders. The Lancet. 2005. 365(9464):1054-1061.
Beiboer, Sigrid HW. et al. Guided selection of a pan carcinoma specific antibody reveals similar binding characteristics yet structural divergence between the original murine antibody and its human equivalent. Journal of Molecular Biology 296(3):833-849 (2000).
Benati, Daniela et al. Public T Cell Receptors Confer High-avidity CD4 Responses to HIV Controllers. Journal of Clinical Investigation 126(6):2093-2108 (2016).
Bendig. Humanization of rodent monoclonal antibodies by CDR grafting. Methods: A Companion to Methods in Enzymology 8:83-93 (1995).
Berge, Stephen M. et al. Pharmaceutical Salts. Journal of Pharmaceutical Sciences 66(1):1-19 (1977).
Biomunex Pharmaceuticals, "Disruptive biological approaches in immunotherapy, based on next generation BiXAb® bi-and multi-specific antibody platform for cancer treatment," Mar. 2023 [PowerPoint Slides].
Blank, Christian. et al. Interaction of PD-L1 on Tumor Cells with PD-1 on Tumor-Specific T cells as a Mechanism of Immune Evasion: Implications for Tumor Immunotherapy. Cancer Immunology, Immunotherapy 54(4):307-314 (2005). Published Online on Dec. 15, 2004.
Bloeman, Pgm. et al. Adhesion Molecules: A New Target for Immunoliposome-mediated Drug Delivery. FEBS Letters 357:140-144 (1995).
Blythe, Martin J, and Darren R Flower. Benchmarking B cell epitope prediction: underperformance of existing methods. Protein science 14(1):246-248 (2005). Published online Dec. 2, 2004.
Boerner, Paula. et al. Production of Antigen-Specific Human Monoclonal Antibodies From in Vitro-primed Human Splenocytes. Journal of Immunology 147(1):86-95 (1991).
Bonsignori et al. Maturation Pathway from Germline to Broad HIV-1 Neutralizer of a CD4-Mimic Antibody. Cell 165(2):449-463 (2016).
Borrebaeck, Carl A K. Antibody Engineering, Second Edition. Oxford University Press: 1-11 (1995).
Bovay, Amandine. et al. T Cell Receptor Alpha Variable 12-2 Bias in the Immunodominant Response to Yellow Fever Virus. European Journal of Immunology 48(2):258-272 (2018).
Brennan, Maureen. et al. Preparation of Bispecific Antibodies by Chemical Recombination of Monoclonal Immunoglobulin G1 Fragments. Science 229(4708):81-83 (1985).
Brennan, Rebekah M. et al. Predictable Alphabeta T-cell Receptor Selection Toward an HLA-B*3501-restricted Human Cytomegalovirus Epitope. Journal of Virology 81(13):7269-7273 (2007).
Brey, et al. A gB/CD3 bispecific BiTE antibody construct for targeting Human Cytomegalovirus-infected cells. Sci Rep 28;8(1):17453 (2018). 12 pages.
Briscoe, Page. et al. Delivery of Superoxide Dismutase to Pulmonary Epithelium via pH-sensitive Liposomes. American Journal of Physiology 268(3 Pt 1):L374-L380 (1995).
Brodeur, Bernard R. et al. Monoclonal Antibody Production Techniques and Applications. New York: Marcel Dekker:51-63 (1987).
Buckland, et al. Fusion glycoprotein of measles virus: nucleotide sequence of the gene and comparison with other paramyxoviruses. Journal of General Virology 68(6):1695-1703 (1987).
Bulek, Anna M. et al. Structural Basis of Human B-cell Killing by CD8+ T cells in Type 1 Diabetes. Nature Immunology 13(3):283-289 (2012).
Caldas, Cristina. et al. Humanization of the anti-CD18 antibody 6.7: an unexpected effect of a framework residue in binding to antigen. Molecular immunology 39(15):941-952 (2003).
Campbell, Peter J. The long-term outlook for essential thrombocythemia. Mayo Clin Proc 81(2):157-8 (2006).
Campbell, Peter J. The myeloproliferative disorders. N Engl J Med 355(23):2452-66 (2006).
Campisi, Laura. et al. Clonally Expanded CD8 T Cells Characterize Amyotrophic Lateral Sclerosis-4. Nature 606(7916):945-952 (2022).
Carnero Contentti, Edgar, et al. Mucosal-Associated Invariant T Cell Features and TCR Repertoire Characteristics During the Course of Multiple Sclerosis. Frontiers in Immunology 10:1-17 (2019).
Carter, Laura L. et al. PD-1: Pd-L Inhibitory Pathway Affects both CD4(+) and CD8(+) T Cells and is Overcome by IL-2. European Journal of Immunology 32(3):634-643 (2002).
Carter, Paul. et al. Humanization of an Anti-p185HER2 Antibody for Human Cancer Therapy. PNAS USA 89(10):4285-4289 (1992).
Cazzola, Mario, and Robert Kralovics. From Janus Kinase 2 to Calreticulin: The Clinically Relevant Genomic Landscape of Myeloproliferative Neoplasms. Blood 123(24):3714-3719 (2014).
Chancellor, A. et al., "CD1b-restricted Gem T cell responses are modulated by Mycobacterium tuberculosis mycolic acid meromycolate chains," PNAS, 2017;114(51):E10956-E10964.
Chang, et al. Opportunities and challenges for TCR mimic antibodies in cancer therapy. Expert Opinion on Biological Therapy 16(8):979-987 (2016).
Chari, Ravi V.J. et al. Immunoconjugates Containing Novel Maytansinoids: Promising Anticancer Drugs. Cancer Research 52(1):127-131 (1992).
Charlton, Keith A. Expression and Isolation of Recombinant Antibody Fragments in *E. coli*. Chapter 14. Methods in Molecular Biology 248:245-254 (2003).
Chen, Lan. et al. The T Cell Repertoires from Nickel Sensitized Joint Implant Failure Patients. International Journal of Molecular Sciences 22(5):2428, 1-13 (2021).
Chen, Yvonne. et al. Selection and Analysis of an Optimized Anti-VEGF Antibody: Crystal Structure of an Affinity-matured Fab in Complex With Antigen. Journal of Molecular Biology 293(4):865-881 (1999).

(56) References Cited

OTHER PUBLICATIONS

Chiu, et al. Antibody Structure and Function: The Basis for Engineering Therapeutics. Antibodies 8(4):55 (2019). 80 pages.

Choi, Yangwon. et al. A method for production of antibodies to human T-cell receptor beta-chain variable regions. Proc Natl Acad Sci USA 88(19):8357-8361 (1991).

Choi, Yoonjoo, and Charlotte M Deane. Predicting antibody complementarity determining region structures without classification. Molecular bioSystems 7(12):3327-3334 (2011).

Chowdhury, Partha S. Engineering Hot Spots for Affinity Enhancement of Antibodies. Methods in Molecular Biology 207:179-196 (2003).

ClinicalTrials.gov Identifier: NCT00001846. Collection and Distribution of Blood Components From Healthy Donors for in Vitro Research Use, Record created Nov. 3, 1999. pp. 1-10. [retrieved on Aug. 22, 2024] Available at URL: https://clinicaltrials.gov/study/NCT00001846.

ClinicalTrials.gov Identifier: NCT01004822. A Safety, Tolerability, and Pharmacokinetic Trial With CVX-241 in Patients With Advanced Solid Tumors, Record created Oct. 28, 2009. pp. 1-17. [retrieved on Jul. 12, 2024] Available at URL: https://clinicaltrials.gov/study/NCT01004822?cond=NCT01004822&rank=1.

ClinicalTrials.gov Identifier: NCT03427411. M7824 in Subjects With HPV Associated Malignancies, Record created Feb. 8, 2018. pp. 1-19. [retrieved on Aug. 22, 2024] Available at URL: https://clinicaltrials.gov/study/NCT03427411?term=NCT03427411&rank=1.

Clynes, Raphael. et al. Fc Receptors are Required in Passive and Active Immunity to Melanoma. Proceedings of the National Academy of Sciences of the United States of America 95(2):652-656 (1998).

Cole, David K. et al. Germ Line-governed Recognition of a Cancer Epitope by an Immunodominant Human T-cell Receptor. Journal of Biological Chemistry 284(40):27281-27289 (2009).

Connolly, James L. et al. Tumor Structure and Tumor Stroma Generation. 6th Edition. Holland-Frei Cancer Medicine :1-5 (2003).

Consonni, M. et al., "Human T cells engineered with a leukemia lipid-specific TCR enables donor-unrestricted recognition of CD1c-expressing leukemia," Nat Commun., 2021;12(1):4844.

Co-pending U.S. Appl. No. 18/286,062, inventors Andreas; Loew et al., filed on Oct. 6, 2023.

Co-pending U.S. Appl. No. 18/659,544, inventors Andreas; Loew et al., filed on May 9, 2024.

Co-pending U.S. Appl. No. 18/779,692, inventor Andreas; Loew, filed on Jul. 22, 2024.

Couzi, Lionel. et al. Antibody-dependent anti-cytomegalovirus activity of human Gamma delta T cells expressing CD16 (FcgammaRIIIa). Blood 119(6):1418-1427 (2012).

Cragg, Mark S, and Martin J Glennie. et al. Antibody Specificity Controls in Vivo Effector Mechanisms of anti-CD20 Reagents. Blood 103(7):2738-2743 (2004).

Cragg, Mark S. et al. Complement-mediated Lysis by Anti-CD20 mAb Correlates with Segregation into Lipid Rafts. Blood 101(3):1045-1052 (2003).

Crowther, Michael D. et al. Genome-wide CRISPR-Cas9 Screening Reveals Ubiquitous T Cell Cancer Targeting via the Monomorphic MHC Class I-related Protein MR1. Nature Immunology 21(2):178-185 (2020).

Cunningham, Brian C, and James A. Wells. High-resolution Epitope Mapping of hGH-receptor Interactions by Alanine-scanning Mutagenesis. Science 244(4908):1081-1085 (1989).

Dahal-Koirala, S. et al. TCR Sequencing of Single Cells Reactive to DQ2.5-glia-α2 and DQ2.5-glia-ω2 Reveals Clonal Expansion and Epitope-specific V-gene Usage. 9(3):587-596 (2016).

Dall'Acqua, William F. et al. Antibody Humanization by Framework Shuffling. Methods 36(1):43-60 (2005).

De Genst, Erwin et al. Antibody Repertoire Development in Camelids. Developmental and Comparative Immunology 30(1-2):187-198 (2006).

Deak, Laura Codarri, et al., PD-1-cis IL-2R Agonism Yields Better Effectors from Stem-like CD8+ T Cells. Nature 610(7930):161-172 (2022).

Delhommeau, François et al. Mutation in TET2 in Myeloid Cancers. N Engl J Med 360(22):2289-2301 (2009).

Desmyter, Aline. et al. Camelid Nanobodies: Killing Two Birds with One Stone. Current Opinion in Structural Biology 32:1-8 (2015).

Dimasi, Nazzareno. et al. The Design and Characterization of Oligospecific Antibodies for Simultaneous Targeting of Multiple Disease Mediators. Journal of Molecular Biology 393(3):672-692 (2009).

Diskin, Ron. et al. Increasing the Potency and Breadth of an HIV Antibody by Using Structure-based Rational Design. Science 334(6060):1289-1293 (2011).

Dondelinger, Mathieu. et al. Understanding the Significance and Implications of Antibody Numbering and Antigen-Binding Surface/Residue Definition. Frontiers in Immunology 9:2278, 1-15 (2018).

Dong, Haidong, and Lieping Chen. B7-H1 Pathway and its Role in the Evasion of Tumor Immunity. Journal of Molecular Medicine 81(5):281-287 (2003).

Draghi, et al. P530 Novel bispecific antibody targeting NKp30 receptor enhances NK-mediated killing activity against multiple myeloma cells and overcomes CD16A deficiency. Abstract. In Meeting Abstracts: 33rd Annual Meeting & Pre-Conference Programs of the Society for Immunotherapy of Cancer (STIC 2018). 8 pages.

Du, Jiamu. et al. Molecular basis of recognition of human osteopontin by 23C3, a potential therapeutic antibody for treatment of rheumatoid arthritis. Journal of molecular biology 382(4):835-842 (2008).

Dubowchik, Gene M. et al. Doxorubicin Immunoconjugates Containing Bivalent, Lysosomally-cleavable Dipeptide Linkages. Bioorganic & Medicinal Chemistry Letters 12(11):1529-1532 (2002).

Duncan, Alexander R, and Greg Winter. The Binding Site for C1q on IgG. Nature 332(6166):738-740 (1988).

Dupuis, Marc et al. Dendritic Cells Internalize Vaccine Adjuvant After Intramuscular Injection. Cell Immunology 186(1):18-27 (1998).

Edwards, Bryan M. et al. The Remarkable Flexibility of the Human Antibody Repertoire; Isolation of Over One Thousand Different Antibodies to a Single Protein, BLyS. Journal of Molecular Biology 334(1):103-118 (2003).

Ernst, et al. Inactivating mutations of the histone methyltransferase gene EZH2 in myeloid disorders. Nat Genet 42(8):722-6 (2010).

Fellouse, Frederic A. et al. Synthetic Antibodies From a Four-amino-acid Code: a Dominant Role for Tyrosine in Antigen Recognition. Proceedings of the National Academy of Sciences 24:101(34):12467-12472 (2004).

Fernandez-Sesma, Ana. et al. A bispecific antibody recognizing influenza A virus M2 protein redirects effector cells to inhibit virus replication in vitro. Journal of virology 70(7):4800-4804 (1996).

Ferrari De Andrade, et al. Natural killer cells are essential for the ability of BRAF inhibitors to control BRAFV600E-mutant metastatic melanoma. Cancer research 74(24):7298-7308 (2014).

Fix, J A. et al. Oral Controlled Release Technology for Peptides: Status and Future Prospects. Pharmaceutical research 13(12):1760-1764 (1996).

Flatman, Stephen. et al. Process Analytics for Purification of Monoclonal Antibodies. Journal of Chromatography 848:79-87 (2007). Published Online on Dec. 11, 2006.

Fontana, Angelo. et al. Probing the Partly Folded States of Proteins by Limited Proteolysis. Folding & Design 2(2):R17-R26 (1997).

Freeman, Gordon. et al. Engagement of the PD-1 Immunoinhibitory Receptor by a Novel B7 Family Member Leads to Negative Regulation of Lymphocyte Activation. Journal of Experimental Medicine 192(7):1027-1034 (2000).

Frick, Rahel. et al. A TRAV26-1-encoded Recognition Motif Focuses the Biased T Cell Response in Celiac Disease. European Journal of Immunology 50(1):142-145 (2020).

Gabrilovich, D I. et al. IL-12 and Mutant P53 Peptide-Pulsed Dendritic Cells for the Specific Immunotherapy of Cancer. Journal of Immunotherapy with Emphasis on Tumor Immunology 19(6):414-418 (1996).

(56) References Cited

OTHER PUBLICATIONS

Gacerez, Albert T. et al. How Chimeric Antigen Receptor Design Affects Adoptive T Cell Therapy. Journal of cellular physiology 231(12):2590-2598 (2016).
Galvin, Teresa A. Effect of different promoters on immune responses elicited by HIV-1 gag/env multigenic DNA vaccine in Macaca mulatta and Macaca nemestrina. Vaccine 18(23):2566-2583 (2000).
Gamvrellis, Anita. et al. Vaccines That Facilitate Antigen Entry Into Dendritic Cells. Immunology & Cell Biology 82(5):506-516 (2004).
Gazzano-Santoro, Helene. et al. A Non-radioactive Complement-dependent Cytotoxicity Assay for Anti-cd20 Monoclonal Antibody. Journal of Immunological Methods 202(2):163-171 (1996).
Gedda, Mallikarjuna R. et al. Longitudinal transcriptional analysis of peripheral blood leukocytes in COVID-19 convalescent donors. J Transl Med 20(1):587, 1-16 (2022).
GenBank Accession No. 2ERJ_D. Version 2ERJ_D. Chain D, Interleukin-2. Record created Mar. 21, 2006. 2 pages. Retrieved Jul. 15, 2024 at URL: https://www.ncbi.nlm.nih.gov/protein/90109213.
GenBank Accession No. AAA62478.2. Version No. AAA62478.2. induced by lymphocyte activation; similar to Human receptor protein encoded by GenBank Accession No. U03397 [*Homo sapiens*]. Record created Jun. 12, 1993. 2 Pages. Retrieved Aug. 1, 2024 at URL: https://www.ncbi.nlm.nih.gov/protein/AAA62478.
GenBank Accession No. AAH66254. Version No. AAH66254.1. Interleukin 2 [*Homo sapiens*]. Record created Feb. 12, 2004. 2 Pages. Retrieved Jul. 12, 2024 at URL: https://www.ncbi.nlm.nih.gov/protein/AAH66254.
GenBank Accession No. BAG36664. Version No. BAG36664.1. unnamed protein product [*Homo sapiens*]. Record created May 23, 2008. 2 Pages. Retrieved Aug. 1, 2024 at URL: https://www.ncbi.nlm.nih.gov/protein/BAG36664.
GenBank Accession No. NM_005191. Version No. NM_005191.4. *Homo sapiens* CD80 Molecule (CD80), mRNA. Record created May 24, 1999. Retrieved Aug. 2, 2024. Retrieved from: https://www.ncbi.nlm.nih.gov/nuccore/NM_005191.
GenBank Accession No. NP002174. Version No. NP_002174.1. interleukin-3 receptor subunit alpha isoform 1 precursor [*Homo sapiens*]. Record created Mar. 14, 2021. 3 Pages. Retrieved Aug. 1, 2024 at URL: https://www.ncbi.nlm.nih.gov/protein/NP_002174.
Gerngross, Tillman U. Advances in the Production of Human Therapeutic Proteins in Yeasts and Filamentous Fungi. Nature Biotechnology 22(11):1409-1414 (2004).
Gershoni, Jonathan M. et al. Epitope mapping: the first step in developing epitope-based vaccines. BioDrugs 21(3):145-156 (2007).
Gherardin, Nicholas A. et al. Human blood MAIT cell subsets defined using MR1 tetramers. Immunology and cell biology 96(5):507-525 (2018).
Giaccone, Giuseppe. et al. A phase I study of the natural killer T-cell ligand alpha-galactosylceramide (KRN7000) in patients with solid tumors. Clinical cancer research 8(12):3702-3709 (2002).
Godfrey, Dale I. et al. The Burgeoning Family of Unconventional T Cells. Nature Immunology 16(11):1114-1123 (2015).
Graham, Frank L. et al. Characteristics of a Human Cell line Transformed by DNA from Human Adenovirus type 5. Journal of General Virology 36(1):59-72 (1977).
Gruber, Meegan. et al. Efficient Tumor Cell Lysis Mediated By a Bispecific Single Chain Antibody Expressed in *Escherichia coli*. Journal of Immunology 152(11):5368-5374 (1994).
Gussow et al., Chapter 5: Humanization of Monoclonal Antibodies. Methods in Enzymology. 203:99-121 (1991).
Hamers-Casterman, C. et al. Naturally Occurring Antibodies Devoid of Light Chains. Nature 363(6428):446-448 (1993).
Harutyunyan, et al. p53 lesions in leukemic transformation. N Engl J Med 364(5):488-90 (2011).
Harutyunyan, et al. Rare germline variants in regions of loss of heterozygosity may influence clinical course of hematological malignancies. Leukemia 25(11):1782-4 (2011).
Hashimoto, M, et al., PD-1 Combination Therapy with IL-2 Modifies CD8+ T Cell Exhaustion Program. Nature 610(7930):173-181 (2022).
He, X.Y. et al. TRAV gene expression in PBMCs and TILs in patients with breast cancer analyzed by a DNA melting curve (FQ-PCR) technique for TCR α chain CDR3 spectratyping. Neoplasma 59(6):693-699 (2012).
Helliwell, P S, and W J Taylor. Classification and Diagnostic Criteria for Psoriatic Arthritis. Annals of the Rheumatic Diseases 64(Suppl 2):ii3-ii8 (2005).
Hinks, Timothy S. C. and Xia-Wei Zhang. MAIT Cell Activation and Functions. Frontiers in Immunology 11:1014, 1-10 (2020).
Hinman, Lois M. et al. Preparation and Characterization of Monoclonal Antibody Conjugates of the Calicheamicins: A Novel and Potent Family of Antitumor Antibiotics. Cancer Research 53(14):3336-3342 (1993).
Holliger, Philipp. et al. "Diabodies": Small Bivalent and Bispecific Antibody Fragments. Proceedings of the National Academy of Sciences of the United States of America 90(14):6444-6448 (1993).
Holmström, M O. et al. The calreticulin (CALR) exon 9 mutations are promising targets for cancer immune therapy. Leukemia 32(2):429-437 (2018).
Holmström, Morten Orebo, and Hans Carl Hasselbalch. Cancer immune therapy for myeloid malignancies: present and future. Seminars in Immunopathology 41(1):97-109 (2019).
Holmstrom, M O. et al. The CALR Exon 9 Mutations Are Shared Neoantigens in Patients With Calr Mutant Chronic Myeloproliferative Neoplasms. Leukemia 30(12):2413-2416 (2016).
Hong, Sung Noh. et al. Reduced diversity of intestinal T-cell receptor repertoire in patients with Crohn's disease. Frontiers in Cellular and Infection Microbiology 12:1-12 (2022).
Hoogenboom, Hennie R, and Greg Winter. By-Passing Immunisation: Human Antibodies From Synthetic Repertoires of Germline VH Gene Segments Rearranged in Vitro. Journal of Molecular Biology 227(2):381-388 (1992).
Hoogenboom, Hennie R. Overview of Antibody Phage-display Technology and Its Applications. Methods in Molecular Biology 178:1-37 (2002).
Horna, Pedro. et al. Utility of TRBC1 expression in the diagnosis of peripheral blood involvement by cutaneous T-cell lymphoma. Journal of Investigative Dermatology 141(4):821-829.e2 (2021).
Howson, Lauren J. et al. MAIT cell clonal expansion and TCR repertoire shaping in human volunteers challenged with *Salmonella* Paratyphi A. Nat Commun 9(1):253, 1-11 (2018).
Hsu, Jonathan. et al. AT cell receptor β chain-directed antibody fusion molecule activates and expands subsets of T cells to promote antitumor activity. Science translational medicine 15(724):eadi0258, 1-18 (2023).
Hsu, Jonathan. et al. Supplementary Materials for: A T Cell Receptor β Chain-directed Antibody Fusion Molecule Activates and Expands Subsets of T Cells to Promote Antitumor Activity. Science Translational Medicine 15(724):eadi0258, 1-39 (2023).
Huang, Huang. et al. Select sequencing of clonally expanded CD8+ T cells reveals limits to clonal expansion. Proc Natl Acad Sci U S A 116(18):8995-9001 (2019).
Huda, Taha I. et al. Specific HLA Alleles, Paired With TCR V- and J-gene Segment Usage, Link to Distinct Multiple Myeloma Survival Rates. Leukemia & Lymphoma 62(7):1711-1720 (2021).
Hudson, Peter J, and Christelle Souriau. Engineered Antibodies. Nature Medicine 9(1):129-134 (2003).
Human NKp30/NCR3 Antibody. Catalog No. MAB1849. Clone 210845 was used by HLDA to establish CD designation. [Website] R&D Systems. Retrieved Jul. 27, 2024 at URL: https://www.rndsystems.com/products/human-nkp30-ncr3-antibody-210845_mab1849. 7 pages.
Human NKp30/NCR3 Antibody. Catalog No. MAB18491. Source: Monoclonal Mouse lgG2A Clone No. 210847. [Website] R&D Systems. Retrieved Nov. 23, 2023 at URL: https://www.rndsystems.com/products/human-nkp30-ncr3-antibody-210847_mab18491#productdetails. 6 pages.
Hussain, Khiyam. et al. 1392 An Atypical Central Memory like Phenotype Can be Induced in Human T Cells by Innate TCRa Engagement. J. Immuno Ther. Cancer 10(suppl 2):A1447 (2022).
Idusogie, Eshoe E. et al. Mapping of the C1q Binding Site on Rituxan, A Chimeric Antibody with a Human lgG1 Fc. The Journal of Immunology 164(8):4178-4184 (2000).

(56) References Cited

OTHER PUBLICATIONS

Imai-Nishiya, Harue et al. Double Knockdown of Alpha1,6-fucosyltransferase (FUT8) and GDP-mannose 4,6-dehydratase (GMD) In Antibody-producing Cells: A New Strategy for Generating Fully Non-fucosylated Therapeutic Antibodies With Enhanced ADCC. BMC Biotechnology 7:84, 1-13 (2007).
Ipilimumab. CAS 477202-00-9. chemicalbook.com [Website] Retrieved Oct. 8, 2024 at: https://www.chemicalbook.com/CASEN_477202-00-9.htm. 3 pages.
James, et al. A JAK2 mutation in myeloproliferative disorders: pathogenesis and therapeutic and scientific prospects. Trends Mol Med 11(12):546-54 (2005).
James, et al. A unique clonal JAK2 mutation leading to constitutive signalling causes polycythaemia vera. Nature. 2005;434:1144-1148.
Janeway Jr, Charles A. et al. The rearrangement of antigen-receptor gene segments controls lymphocyte development. Immunobiology: The Immune System in Health and Disease. 5th Edition. New York: Garland Science. 1-17 (2001).
Jeffrey, Scott C. et al. Dipeptide-based Highly Potent Doxorubicin Antibody Conjugates. Bioorganic Medicinal Chemistry Letters 16(2):358-362 (2006).
Johnsson, Bo. et al. Comparison of Methods for Immobilization to Carboxymethyl Dextran Sensor Surfaces By Analysis of the Specific Activity of Monoclonal Antibodies. Journal of Molecular Recognition 8(1-2):125-131 (1995).
Johnsson, Bo. et al. Immobilization of Proteins to a Carboxymethyldextran-modified Gold Surface for Biospecific Interaction Analysis in Surface Plasmon Resonance Sensors. Analytical Biochemistry 198(2):268-277 (1991).
Jonsson, U. et al. Introducing a Biosensor Based Technology for Real-time Biospecific Interaction Analysis. Annals of Clinical Biology 51(1):19-26 (1993).
Jonsson, U. et al. Real-time Biospecific Interaction Analysis Using Surface Plasmon Resonance and a Sensor Chip Technology. BioTechniques 11(5):620-627 (1991).
Jung, S. et al. Prevention and therapy of experimental autoimmune neuritis by an antibody against T cell receptors-alpha/beta. Journal of immunology 148(12):3768-3775 (1992).
Kabat, Elvin A. et al. Sequences of Proteins of Immunological Interest. Fifth Edition, NIH Pub. No. 91-3242. Public Health Service, U.S. Department of Health and Human Services, National Institutes of Health: 647-669 (1991).
Kam, Nadine Wong Shi. et al. Carbon Nanotubes as Multifunctional Biological Transporters and Near-infrared Agents for Selective Cancer Cell Destruction. Proceedings of the National Academy of Sciences of the United States of America 102(33):11600-11605 (2005).
Kanda, Yutaka. et al. Comparison of Cell Lines for Stable Production of Fucose-negative Antibodies With Enhanced ADCC. Biotechnology and Bioengineering 94(4):680-688 (2006).
Karlin, Samuel, and Stephen F. Altschul. Applications and Statistics for Multiple High-scoring Segments in Molecular Sequences. PNAS USA 90(12):5873-5877 (1993).
Kashmiri, Syed V S. et al. SDR Grafting—a New Approach to Antibody Humanization. Methods 36(1):25-34 (2005).
Kasmar, A.G. et al., "CD1b tetramers bind αβ T cell receptors to identify a mycobacterial glycolipid-reactive T cell repertoire in humans," J Exp Med., 2011;208(9):1741-1747.
Keinanen, A, and M L Laukkanen. Biosynthetic Lipid-tagging of Antibodies. FEBS letters 346(1):123-126 (1994).
Killion, J J, and I J Fidler. Systemic Targeting of Liposome-encapsulated Immunomodulators to Macrophages for Treatment of Cancer Metastasis. ImmunoMethods 4(3):273-279 (1994).
King, H Dalton. et al. Monoclonal Antibody Conjugates of Doxorubicin Prepared With Branched Peptide Linkers: Inhibition of Aggregation by Methoxytriethyleneglycol Chains. Journal of Medicinal Chemistry 45(19):4336-4343 (2002).
Klampfl, Thorsten. et al. Genome Integrity of Myeloproliferative Neoplasms in Chronic Phase and During Disease Progression. Blood 118(1):167-176 (2011).

Klimka, A. et al. Human Anti-CD30 Recombinant Antibodies by Guided Phage Antibody Selection Using Cell Panning. British Journal of Cancer 83(2):252-260 (2000).
Konishi, Jun. et al. B7-H1 Expression on Non-small Cell Lung Cancer Cells and Its Relationship With Tumor-infiltrating Lymphocytes and Their PD-1 Expression. Clinical Cancer Research 10(15):5094-5100 (2004).
Kostelny, S A. et al. Formation of a Bispecific Antibody by the Use of Leucine Zippers. Journal of Immunology 148(5):1547-1553 (1992).
Kozbor, D. et al. A Human Hybrid Myeloma for Production of Human Monoclonal Antibodies. Journal of Immunology 133(6):3001-3005 (1984).
Kralovics, et al. Altered gene expression in myeloproliferative disorders correlates with activation of signaling by the V617F mutation of Jak2. Blood 106(10):3374-6 (2005).
Kralovics, et al. Molecular pathogenesis of Philadelphia chromosome negative myeloproliferative disorders. Blood Rev 19(1):1-13 (2005).
Kralovics, Robert. et al. A Gain-of-function Mutation of JAK2 in Myeloproliferative Disorders. The New England Journal of Medicine 352(17):1779-1790 (2005).
Kralovics, Robert. Genetic Complexity of Myeloproliferative Neoplasms. Leukemia 22(10):1841-1848 (2008).
Kratz, F. et al. Prodrugs of Anthracyclines in Cancer Chemotherapy. Current Medicinal Chemistry 13(5):477-523 (2006).
Kronenberg, M. et al., "A 'Gem' of a cell," Nat Immunol., 2013;14(7):694-695.
Kunik, Vered. et al. Structural consensus among antibodies defines the antigen binding site. PLoS computational biology 8(2):e1002388, 1-12 (2012).
Ladner, Robert C. Mapping the epitopes of antibodies. Biotechnology and genetic engineering reviews 24(1):1-30 (2007).
Latchman, Yvette. et al. PD-L2 is a Second Ligand for PD-1 and Inhibits T Cell Activation. Nature Immunology 2(3):261-268 (2001).
Lee, Chingwei V. et al. Bivalent Antibody Phage Display Mimics Natural Immunoglobulin. Journal of Immunological Methods 284(1-2):119-132 (2004).
Lee, Chingwei V. et al. High-affinity Human Antibodies From Phage-displayed Synthetic Fab Libraries With a Single Framework Scaffold. Journal of Molecular Biology 340(5):1073-1093 (2004).
Lepore, Marco. et al. Functionally Diverse Human T cells Recognize non-microbial Antigens Presented by MR1.Elife 6:e24476, 1-22 (2017).
Levine, et al. The JAK2V617F activating mutation occurs in chronic myelomonocytic leukemia and acute myeloid leukemia, but not in acute lymphoblastic leukemia or chronic lymphocytic leukemia. Blood 106(10):3377-9 (2005).
Levine, Ross L. et al. Activating Mutation in the Tyrosine Kinase JAK2 in Polycythemia Vera, Essential Thrombocythemia, and Myeloid Metaplasia With Myelofibrosis. Cancer Cell 7(4):387-397 (2005).
Li, Huijuan. et al. Optimization of Humanized IgGs in Glycoengineered Pichia Pastoris. Nature Biotechnology 24(2):210-215 (2006).
Li, Jian. et al. Human Antibodies for Immunotherapy Development Generated via a Human B Cell Hybridoma Technology. Proceedings of the National Academy of Sciences of the United States of America 103(10):3557-3562 (2006).
Li, Yangqiu. et al. Restricted TRBV repertoire in CD4+ and CD8+ T-cell subsets from CML patients. Hematology 16(1):43-49 (2011).
Lifely, M R. et al. Glycosylation and biological activity of CAMPATH-1H Expressed in different Cell lines and Grown under different Culture Conditions. Glycobiology 5(8):813-822 (1995).
Lin, Yuan. et al. Improved Affinity of a Chicken Single-chain Antibody to Avian Infectious Bronchitis Virus by Site-directed Mutagenesis of Complementarity-determining Region H3. African Journal of Biotechnology 10(79):18294-18302 (2011).
Lode, Holger N. et al. Targeted Therapy With a Novel Enediyene Antibiotic Calicheamicin Theta(I)1 Effectively Suppresses Growth and Dissemination of Liver Metastases in a Syngeneic Model of Murine Neuroblastoma. Cancer Research 58(14):2925-2928 (1998).
Lonberg, Nils. Fully Human Antibodies From Transgenic Mouse and Phage Display Platforms. Current Opinion in Immunology 20(4):450-459 (2008).

(56) References Cited

OTHER PUBLICATIONS

Lonberg, Nils. Human Antibodies From Transgenic Animals. Nature Biotechnology 23(9):1117-1125 (2005).
Lopez, K. et al., "CD1b Tetramers Broadly Detect T Cells That Correlate With Mycobacterial Exposure but Not Tuberculosis Disease State," Front Immunol., 2020;11:199.
Lossius, Andreas. et al. High-throughput Sequencing of TCR Repertoires in Multiple Sclerosis Reveals Intrathecal Enrichment of EBV-reactive CD8+ T Cells. European of Journal Immunnology 44(11):3439-3452 (2014).
Lu, Chenyang. et al. Clinical Significance of T Cell Receptor Repertoire in Primary Sjogren's Syndrome. EBioMedicine 84:104252, 1-12 (2022).
Lydard, Peter. et al. In Antibodies: Generation of diversity. Immunology :76-85 (2011).
Maciocia, Paul M. et al. Supplemental Figures: Targeting the T cell receptor β-chain constant region for immunotherapy of T cell malignancies. Nature Medicine 23(12):1416-1423 (2017). Retrieved Oct. 8, 2024 at URL: https://static-content.springer.com/esm/art%3A10.1038%2Fnm.4444/MediaObjects/41591_2017_BFnm4444_MOESM1_ESM.pdf. 6 pages.
Maeda, T. et al. Amelioration of acute graft-versus-host disease and re-establishment of tolerance by short-term treatment with an anti-TCR antibody. Journal of immunology 153(9):4311-4320 (1994).
Marks, James D, and Andrew Bradbury. Selection of Human Antibodies From Phage Display Libraries. Methods in Molecular Biology 48:161-176 (2004).
Marks, James D. et al. By-passing Immunization Human Antibodies from V-gene Libraries Displayed on Phage. Journal of Molecular Biology 222(3):581-597 (1991).
Martin, Andrew CR. Protein Sequence and Structure Analysis of Antibody Variable Domains. Antibody Engineering:422-439 (2001).
Matsumoto, Y. et al. Successful prevention and treatment of autoimmune encephalomyelitis by short-term administration of anti-T-cell receptor alpha beta antibody. Immunology 81(1):1-7 (1994).
Mayer, Gene. et al. Chapter 10: Major Histocompatibility Complex (MHC) and T-Cell Receptors—Role in Immune Responses. In: Microbiology and Immunology on-line, University of South Carolina School of Medicine: 1-6 (2010).
McCafferty, J. et al. Phage Antibodies: Filamentous Phage Displaying Antibody Variable Domains. Nature 348(6301):552-554 (1990).
McGoff, Paul, and David S. Scher. Solution Formulation of Proteins/Peptides:In McNally EJ., ed, Protein Formulation and Delivery: 139-158 (2000).
McLaughlin-Taylor, Elizabeth. et al. Identification of the major late human cytomegalovirus matrix protein pp65 as a target antigen for CD8+ virus-specific cytotoxic T lymphocytes. Journal of medical virology 43(1):103-110 (1994).
McLellan, Jason S. et al. Structure of HIV-1 gp120 V1/V2 Domain with Broadly Neutralizing Antibody PG9. Nature 480(7377):336-343 (2011).
Meermeier, Erin W. et al. Human TRAV1-2-negative MR1-restricted T cells detect S. pyogenes and alternatives to MAIT riboflavin-based antigens. Nat Commun 7:12506, 1-12 (2016).
Meeting Abstracts. 33rd Annual Meeting & Pre-Conference Programs of the Society for Immunotherapy of Cancer (SITC 2018). Journal for Immunotherapy of Cancer 6(Suppl 1): No. 115, pp. 207-398 (2018).
Meilleur, Courtney. et al. Bacterial Superantigens Expand and Activate, Rather than Delete or Incapacitate, Preexisting Antigen-Specific Memory CD8+ T Cells. J Infect Dis 219(8):1307-1317 (2019). Published online Nov. 12, 2018.
Milosevic, Jelena D, and Robert Kralovics. Genetic and Epigenetic Alterations of Myeloproliferative Disorders. International Journal of Hematology 97(2):183-197 (2013). Published Online Dec. 12, 2012.
Milstein, C, and A C Cuello. Hybrid Hybridomas and Their Use in Immunohistochemistry. Nature 305(5934):537-540 (1983).
Moore, et al. Abstract C180: A novel bispecific platform for potent redirected killing of B-cell lymphoma. Mol Cancer Ther 8 (12_Supplement): C180 (2009).
Mosca, Paul J. et al. Dendritic cell vaccines. Frontiers in Bioscience 12:4050-4060 (2007).
Motozono, Chihiro. et al. Molecular Basis of a Dominant T Cell Response to an HIV Reverse Transcriptase 8-mer Epitope Presented by the Protective Allele HLA-B*51:01. Journal of Immunology 192(7):3428-3434 (2014).
Myers, et al. Optimal alignments in linear space. Cabios 4(1):11-17 (1988).
Nagy, Attila. et al. Stability of Cytotoxic Luteinizing Hormone-releasing Hormone Conjugate (AN-152) Containing Doxorubicin 14-O-Hemiglutarate in Mouse and Human Serum in vitro: Implications for the Design of Preclinical Studies. Proc Natl Acad Sci U S A 97(2):829-834 (2000).
Natsume, Akito et al. Engineered Antibodies of IgG1/IgG3 Mixed Isotype with Enhanced Cytotoxic Activities. Cancer Research 68(10):3863-3872 (2008).
Ni, Jian. Research Progress and Prospects of Antibodymoics and Antibody-Based Drugs, Modern Immunology 26(4):265-268 (2006). Abstract Only. One page.
Nomoto, K. et al. Tolerance induction in a fully allogeneic combination using anti-T cell receptor-alpha beta monoclonal antibody, low dose irradiation, and donor bone marrow transfusion. Transplantation 59(3):395-401 (1995).
Ohtsuka, Eiko. et al. An Alternative Approach to Deoxyoligonucleotides as Hybridization Probes by Insertion of Deoxyinosine at Ambiguous Codon Positions. Journal of Biological Chemistry 260(5):2605-2608 (1985).
Okazaki, Akira. et al. Fucose Depletion From Human IgG1 Oligosaccharide Enhances Binding Enthalpy and Association Rate Between IgG1 and FcgammaRIIIa. Journal of Molecular Biology 336(5):1239-1249 (2004).
Osbourn, Jane. et al. From Rodent Reagents to Human Therapeutics Using Antibody Guided Selection. Methods 36(1):61-68 (2005).
Owais, Mohammad. et al. Chloroquine Encapsulated in Malaria-infected Erythrocyte-specific Antibody-bearing Liposomes Effectively Controls Chloroquine-resistant Plasmodium Berghei Infections in Mice. Antimicrobial Agents and Chemotherapy 39(1):180-184 (1995).
Padlan, Eduardo A. A Possible Procedure for Reducing the Immunogenicity of Antibody Variable Domains While Preserving Their Ligand-binding Properties. Molecular Immunology 28(4-5):489-498 (1991).
Panka, David J. et al. Variable region framework differences result in decreased or increased affinity of variant anti-digoxin antibodies. Proceedings of the National Academy of Sciences of the United States of America 85(9):3080-3084 (1988).
Pardanani, Animesh D. et al. MPL515 Mutations in Myeloproliferative and Other Myeloid Disorders: a Study of 1182 Patients. Blood 108(10):3472-3476 (2006).
Pardanani, et al. Discordant distribution of JAK2V617F mutation in siblings with familial myeloproliferative disorders. Blood 107(11):4572-3 (2006).
Paul: Fundamental Immunology. 3rd Edition. 292-295 (1993).
PCT/US2017/023483 International Search Report and Written Opinion dated Aug. 29, 2017.
PCT/US2020/019329 International Search Report and Written Opinion dated Jun. 26, 2020.
PCT/US2020/060557 International Search Report and Written Opinion dated Mar. 30, 2021.
PCT/US2021/047574 International Search Report and Written Opinion dated Feb. 17, 2022.
PCT/US2021/047773 International Search Report and Written Opinion dated Dec. 23, 2021.
PCT/US2022/023922 International Search Report and Written Opinion dated Oct. 6, 2022.
PCT/US2022/049039 International Search Report and Written Opinion dated May 10, 2023.
PCT/US2022/053705 International Search Report and Written Opinion dated Jul. 7, 2023.

(56) References Cited

OTHER PUBLICATIONS

PCT/US2023/011280 International Search Report and Written Opinion dated Jun. 28, 2023.
PCT/US2023/034966 International Search Report and Written Opinion dated Mar. 29, 2024.
PCT/US2023/035056 International Search Report and Written Opinion dated Mar. 5, 2024.
PCT/US2024/025875 International Search Report and Written Opinion dated Dec. 17, 2024.
PCT/US2024/026686 International Search Report and Written Opinion dated Sep. 23, 2024.
Pearson, William R, and David J. Lipman. Improved Tools for Biological Sequence Comparison. Proceedings of the National Academy of Sciences 85(8):2444-2448 (1988).
Pejchal, Robert. et al. A Potent and Broad Neutralizing Antibody Recognizes and Penetrates the HIV Glycan Shield. Science 334(6059):1097-1103 (2011).
Petersen, Jan. et al. Diverse T Cell Receptor Gene Usage in HLA-DQ8-associated Celiac Disease Converges Into a Consensus Binding Solution. Structure 24(10):1643-1657 (2016).
Petkova, Stefka B. et al. Enhanced Half-life of Genetically Engineered Human lgG1 Antibodies in a Humanized FcRn Mouse Model: Potential Application in Humorally Mediated Autoimmune Disease. International Immunology 18(12):1759-1769 (2006).
Pikman, et al. MPLW515L Is a Novel Somatic Activating Mutation in Myelofibrosis with Myeloid Metaplasia. PLoS Med. 2006;3(7):e270.
Pluckthun, A. Chapter 11: Antibodies From *Escherichia coli*. The Pharmacology of Monoclonal Antibodies 113:269-315 (1994).
Porritt, Rebecca A. et al. HLA Class I-associated Expansion of TRBV11-2 T Cells in Multisystem Inflammatory Syndrome in Children. The Journal of Clinical Investigation 131(10):e146614, 1-13 (2021).
Presta, Leonard G. et al. Humanization of an Antibody Directed Against lgE. Journal of Immunology 151(5): 2623-2632 (1993).
Presta, Leonard G. et al. Humanization of an Anti-vascular Endothelial Growth Factor Monoclonal Antibody for the Therapy of Solid Tumors and Other Disorders. Cancer Research 57(20):4593-4599 (1997).
Queen, Cary. et al. A Humanized Antibody That Binds to the Interleukin 2 Receptor. Proceedings of the National Academy of Sciences 86(24):10029-10033 (1989).
Ranade, Vasant V. Drug Delivery Systems. 1. Site-specific Drug Delivery Using Liposomes as Carriers. Journal of Clinical Pharmacology 29(8):685-694 (1989).
Reinink, P. et al., "A TCR β-Chain Motif Biases toward Recognition of Human CD1 Proteins," J Immunol., 2019;203(12):3395-3406.
Riechmann, Lutz. et al. Reshaping Human Antibodies for Therapy. Nature 332(6162):323-327 (1988).
Ripka, James. et al. Two Chinese Hamster Ovary Glycosylation Mutants Affected in the Conversion of GDP-mannose to GDP-fucose. Archives of Biochemistry and Biophysics 249(2):533-545 (1986).
Rosok, Mae Joanne. et al. A Combinatorial Library Strategy for the Rapid Humanization of Anticarcinoma BR96 Fab. The Journal of Biological Chemistry 271(37):22611-22618 (1996).
Rossolini, Gian Maria et al. Use of Deoxyinosine-containing Primers vs Degenerate Primers for Polymerase Chain Reaction Based on Ambiguous Sequence Information. Molecular and Cellular Probes 8(2):91-98 (1994).
Rowntree, Louise C. et al. A Shared TCR Bias Toward an Immunogenic EBV Epitope Dominates in HLA-B*07:02-Expressing Individuals. Journal of Immunology 205(6):1524-1534 (2020).
Samanen, James. et al. Chemical Approaches to Improve the Oral Bioavailability of Peptidergic Molecules. Journal of Pharmacy and Pharmacology 48(2):119-135 (1996).
Sanchez-Ruiz, Jose M. et al. Differential Scanning Calorimetry of the Irreversible Thermal Denaturation of Thermolysin. Biochemistry 27(5):1648-1652 (1988).
Schachter, Harry. et al. Biosynthetic Controls that Determine the Branching and Microheterogeneity of Protein-bound Oligosaccharides. Biochemistry and Cell Biology 64(3):163-181 (1986).
Scheid, Johannes F. et al. Sequence and Structural Convergence of Broad and Potent HIV Antibodies that Mimic CD4 Binding. Science 333(6049):1633-1637 (2011).
Scheuermann, R.H. and Racila, E. CD19 Antigen in Leukemia and Lymphoma Diagnosis and Immunotherapy. Leukemia & Lymphoma 18(5-6):385-397 (1995).
Schreiber, Andreas. et al. 3D-Epitope-Explorer (3DEX): localization of conformational epitopes within three-dimensional structures of proteins. Journal of computational chemistry 26(9):879-887 (2005).
Schreier, Hans. et al. Targeting of Liposomes to Cells Expressing CD4 Using Glycosylphosphatidylinositol-anchored gp120. Influence of Liposome Composition on Intracellular Trafficking. The Journal of Biological Chemistry 269(12):9090-9098 (1994).
Scott, et al. JAK2 exon 12 mutations in polycythemia vera and idiopathic erythrocytosis. N Engl J Med 356(5):459-68 (2007).
Shields, Robert L. et al. High Resolution Mapping of the Binding Site on Human lgG1 for Fc Gamma RI, Fc Gamma RII, Fc Gamma Rlll, and FcRn and design of lgG1 Variants with Improved Binding to the Fc Gamma R. Journal of Biological Chemistry 276(9):6591-6604 (2001).
Sidhu, Sachdev S. et al. Phage-displayed Antibody Libraries of Synthetic Heavy Chain Complementarity Determining Regions. Journal of Molecular Biology 338(2):299-310 (2004).
Sim, Gek Kee. et al. Primary Structure of Human T-Cell Receptor Alpha-chain. Nature 312(5996):771-775 (1984).
Sims, Martin J. et al. A Humanized CD18 Antibody Can Block Function Without Cell Destruction. Journal of Immunology 151(4):2296-2308 (1993).
Smith, et al. T cell inactivation and cytokine deviation promoted by anti-CD3 mAbs. Curr Opin Immunol 9(5):648-54 (1997).
Smith, Temple F, and Michael S. Waterman. Comparison of Biosequences. Advances in Applied Mathematics 2(4):482-489 (1981).
Song, De-Gang. et al. CD27 Costimulation Augments the Survival and Antitumor Activity of Redirected Human T cells in vivo. Blood 119(3):696-706 (2012).
Srivastava, Shivani, and Stanley R Riddell. Engineering CAR-T cells: Design concepts. Trends in immunology 36(8):494-502 (2015).
Staerz, Uwe D, and Michael J. Bevan. Activation of resting T lymphocytes by a monoclonal antibody directed against an allotypic determinant on the T cell receptor. Eur. J. Immunol 16:263-270 (1986).
Stegelmann, F. et al. DNMT3a Mutations in Myeloproliferative Neoplasms. Leukemia 25(7):1217-1219 (2011).
Stein, et al. Disruption of the ASXL1 gene is frequent in primary, post-essential thrombocytosis and post-polycythemia vera myelofibrosis, but not essential thrombocytosis or polycythemia vera: analysis of molecular genetics and clinical phenotypes. Haematologica 96(10):1462-9 (2011).
Stein, et al. Natural Killer (NK)- and T-Cell Engaging Antibody-Derived Therapeutics. Antibodies 1(1):88-123 (2012).
Stein, Sokrates. et al. Protective Roles of SIRT1 in Atherosclerosis. Cell Cycle 10(4):640-647 (2011).
Streltsov, Victor A. et al. Structure of a Shark lgNAR Antibody Variable Domain and Modeling of an Early-developmental Isotype. Protein Science 14(11):2901-2909 (2005).
Surman, Sherri L. et al. Clonally Related CD8+ T Cells Responsible for Rapid Population of Both Diffuse Nasal-associated Lymphoid Tissue and Lung After Respiratory Virus Infection. Journal of Immunology 187(2):835-841 (2011).
Suzuki-Inoue, et al. Involvement of the Snake Toxin Receptor CLEC-2, in Podoplanin-mediated Platelet Activation, by Cancer Cells. The Journal of Biological Chemistry, 282(36):25993-26001 (2007).
Szeto, Christopher. et al. Molecular Basis of a Dominant SARS-CoV-2 Spike-Derived Epitope Presented by HLA-A*02:01 Recognised by a Public TCR. Cells 10(10):2646, 1-15 (2021).

(56) References Cited

OTHER PUBLICATIONS

Tan, Huo. et al. Clonal expanded TRA and TRB subfamily T cells in peripheral blood from patients with diffuse large B-cell lymphoma. Hematology 15(2):81-87 (2010).
Tang, Yong. et al. Regulation of Antibody-dependent Cellular Cytotoxicity by IgG Intrinsic and Apparent Affinity for Target Antigen. Journal of Immunology 179(5):2815-2823 (2007).
Tastan, Cihan. et al. Tuning of human MAIT cell activation by commensal bacteria species and MR1-dependent T-cell presentation. Mucosal Immunol 11(6):1591-1605 (2018).
Torgov, Michael Y. et al. Generation of an Intensely Potent Anthracycline by a Monoclonal Antibody-beta-galactosidase Conjugate. Bioconjugate Chemistry 16(3):717-721 (2005).
Traunecker, André. et al. Bispecific Single Chain Molecules (Janusins) Target Cytotoxic Lymphocytes on HIV Infected Cells. The EMBO Journal 10(12):3655-3659 (1991).
Tutt, Alison. et al. Trispecific F(ab')3 Derivatives that Use Cooperative Signaling via the TCR/CD3 Complex and CD2 to Activate and Redirect Resting Cytotoxic T cells. Journal of Immunology 147(1):60-69 (1991).
Tutt, Alison L. et al. Activation and preferential expansion of rat cytotoxic (CD8) T cells in vitro and in vivo with a bispecific (anti-TCR alpha/beta x anti-CD2) F(ab')2 antibody. Journal of immunology 155(6):2960-2971 (1995).
Umezawa, F, and Y Eto. Liposome Targeting to Mouse Brain: Mannose as a Recognition Marker. Biochemical and Biophysical Research Communications 153(3):1038-1044 (1988).
UniProt reference No. P04626. Receptor Tyrosine-Protein Kinase erbB-2. Record created Nov. 1, 1988. pp. 1-19. Retrieved Sep. 27, 2024 at URL: https://www.uniprot.org/uniprotkb/P04626/entry.
UniProt reference No. Q9HBE4. Interleukin-21. Record created Mar. 1, 2001. pp. 1-9. Retrieved Sep. 27, 2024 at URL: https://www.uniprot.org/uniprotkb/Q9HBE4/entry.
UniProtKB Accession No. A0A075B6N4. T cell receptor beta variable 25-1. Record created Oct. 1, 2014. pp. 1-9. Retrieved Sep. 9, 2024 at URL: https://www.uniprot.org/uniprotkb/A0A075B6N4/entry.
UniProtKB Accession No. A0A0B4J240. T cell receptor alpha variable 10. Record created Mar. 11, 2015. pp. 1-9. Retrieved Sep. 9, 2024 at URL: https://www.uniprot.org/uniprotkb/A0A0B4J240/entry.
UniProtKB Accession No. A0A1G7UTW6_9SPHI. Uncharacterized protein Pedobacter terrae (Nov. 22, 2017). Retrieved Jul. 16, 2024 at URL: https://rest.uniprot.org/unisave/A0A1G7UTW6?format=txt&versions=1. One page.
UniProtKB Accession No. A0A2V7GPM2_9BACT. Uncharacterized protein Gemmatimonadetes bacterium (Sep. 12, 2018). Retrieved Jul. 16, 2024 at URL: https://rest.uniprot.org/unisave/A0A2V7GPM2?format=txt&versions=1. One page.
UniProtKB Accession No. O00220. Tumor necrosis factor receptor superfamily member 10A. Record created Jul. 1, 1997. Retrieved Aug. 16, 2024 at URL: https://www.uniprot.org/uniprotkb/O00220/entry pp. 1-9.
UniProtKB Accession No. O14763. Tumor necrosis factor receptor superfamily member 10B. Record created Jan. 1, 1998. Retrieved Aug. 16, 2024 at URL: https://www.uniprot.org/uniprotkb/O14763/entry pp. 1-10.
UniProtKB Accession No. O14931. Natural cytotoxicity triggering receptor 3. Record created Jan. 1, 1998. Retrieved Nov. 14, 2024 at URL: https://www.uniprot.org/uniprotkb/014931/entry pp. 1-10.
UniProtKB Accession No. O95760. Interleukin-33. Record created May 1, 1999. pp. 1-10. Retrieved Sep. 9, 2024 at URL: https://www.uniprot.org/uniprotkb/O95760/entry.
UniProtKB Accession No. O95866. Megakaryocyte and platelet inhibitory receptor G6b. Record created May 1, 1999. Retrieved Aug. 16, 2024 at URL: https://www.uniprot.org/uniprotkb/O95866/entry pp. 1-11.
UniProtKB Accession No. P01137. Transforming growth factor beta-1 proprotein. Record created Nov. 1, 1988. Retrieved Aug. 16, 2024 at URL: https://www.uniprot.org/uniprotkb/P01137/entry pp. 1-17.
UniProtKB Accession No. P01562. Interferon alpha-1/13. Record created Nov. 1, 1988. pp. 1-10. Retrieved Sep. 9, 2024 at URL: https://www.uniprot.org/uniprotkb/P01562/entry.
UniProtKB Accession No. P01563. Interferon alpha-2. Record created Nov. 1, 1988. pp. 1-12. Retrieved Oct. 9, 2024 at URL: https://www.uniprot.org/uniprotkb/P01563/entry.
UniProtKB Accession No. P01566. Interferon alpha-10. Record created Nov. 1, 1988. pp. 1-10. Retrieved Sep. 9, 2024 at URL: https://www.uniprot.org/uniprotkb/P01566/entry.
UniProtKB Accession No. P01567. Interferon alpha-7. Record created Nov. 1, 1988. pp. 1-7. Retrieved Sep. 9, 2024 at URL: https://www.uniprot.org/uniprotkb/P01567/entry.
UniProtKB Accession No. P01568. IFN21_HUMAN. Record created Nov. 1, 1988. pp. 1-7. Retrieved Sep. 9, 2024 at URL: https://www.uniprot.org/uniprotkb/P01568/entry.
UniProtKB Accession No. P01569. Interferon alpha-5. Record created Nov. 1, 1988. pp. 1-10. Retrieved Sep. 9, 2024 at URL: https://www.uniprot.org/uniprotkb/P01569/entry.
UniProtKB Accession No. P01570. IFN14_HUMAN. Record created Nov. 1, 1988. pp. 1-7. Retrieved Sep. 9, 2024 at URL: https://www.uniprot.org/uniprotkb/P01570/entry.
UniProtKB Accession No. P01574. Interferon beta. Record created Nov. 1, 1988. pp. 1-9. Retrieved Sep. 9, 2024 at URL: https://www.uniprot.org/uniprotkb/P01574/entry.
UniProtKB Accession No. P01854. Immunoglobulin heavy constant epsilon. Record created Nov. 1, 1988. Retrieved Nov. 15, 2024 at URL: https://www.uniprot.org/uniprotkb/P01854/entry pp. 1-10.
UniProtKB Accession No. P01859. Immunoglobulin heavy constant gamma 2. Record created Nov. 1, 1988. pp. 1-9. Retrieved Oct. 11, 2024 at URL: https://www.uniprot.org/uniprotkb/P01859/entry.
UniProtKB Accession No. P01860. Immunoglobulin heavy constant gamma 3. Record created Nov. 1, 1988. pp. 1-14. Retrieved Oct. 11, 2024 at URL: https://www.uniprot.org/uniprotkb/P01860/entry.
UniProtKB Accession No. P01861. Immunoglobulin heavy constant gamma 4. Record created Nov. 1, 1988. pp. 1-13. Retrieved Oct. 11, 2024 at URL: https://www.uniprot.org/uniprotkb/P01861/entry.
UniProtKB Accession No. P01871. Immunoglobulin heavy constant mu. Record created Nov. 1, 1988. Retrieved Nov. 15, 2024 at URL: https://www.uniprot.org/uniprotkb/P01871/entry pp. 1-12.
UniProtKB Accession No. P01876. Immunoglobulin heavy constant alpha 1. Record created Nov. 1, 1988. Retrieved Nov. 15, 2024 at URL: https://www.uniprot.org/uniprotkb/P01876/entry pp. 1-9.
UniProtKB Accession No. P01877. Immunoglobulin heavy constant alpha 2. Record created Nov. 1, 1988. Retrieved Nov. 15, 2024 at URL: https://www.uniprot.org/uniprotkb/P01877/entry pp. 1-9.
UniProtKB Accession No. P05013. Interferon alpha-6. Record created Nov. 1, 1988. pp. 1-11. Retrieved Sep. 9, 2024 at URL: https://www.uniprot.org/uniprotkb/P05013/entry.
UniProtKB Accession No. P05014. Interferon alpha-4. Record created Nov. 1, 1988. pp. 1-11. Retrieved Sep. 9, 2024 at URL: https://www.uniprot.org/uniprotkb/P05014/entry.
UniProtKB Accession No. P05106. Integrin beta-3. Record created Nov. 1, 1988. Retrieved Aug. 16, 2024 at URL: https://www.uniprot.org/uniprotkb/P05106/entry pp. 1-20.
UniProtKB Accession No. P05107. Integrin beta-2. Record created Nov. 1, 1988. Retrieved Aug. 16, 2024 at URL: https://www.uniprot.org/uniprotkb/P05107/entry pp. 1-15.
UniProtKB Accession No. P07359. Platelet glycoprotein lb alpha chain. Record created Nov. 1, 1988. Retrieved Aug. 16, 2024 at URL: https://www.uniprot.org/uniprotkb/P07359/entry pp. 1-15.
UniProtKB Accession No. P08514. Integrin alpha-IIb. Record created Nov. 1, 1988. Retrieved Aug. 16, 2024 at URL: https://www.uniprot.org/uniprotkb/P08514/entry pp. 1-15.
UniProtKB Accession No. P0DOX5. Immunoglobulin gamma-1 heavy chain. Record created Mar. 15, 2017. Retrieved Nov. 6, 2024 at URL: https://www.uniprot.org/uniprotkb/P0DOX5/entry pp. 1-4.

(56) References Cited

OTHER PUBLICATIONS

UniProtKB Accession No. P10600. Transforming growth factor beta-3 proprotein. Record created Jul. 1, 1989. Retrieved Aug. 16, 2024 at URL: https://www.uniprot.org/uniprotkb/P10600/entry pp. 1-11.
UniProtKB Accession No. P10721. Mast/stem cell growth factor receptor Kit. Record created Jul. 1, 1989. Retrieved Aug. 16, 2024 at URL: https://www.uniprot.org/uniprotkb/P10721/entry pp. 1-20.
UniProtKB Accession No. P12318. Low affinity immunoglobulin gamma Fc region receptor II-a. Record created Oct. 1, 1989. Retrieved Aug. 16, 2024 at URL: https://www.uniprot.org/uniprotkb/P12318/entry pp. 1-9.
UniProtKB Accession No. P16109. P-selectin. Record created Apr. 1, 1990. Retrieved Aug. 16, 2024 at URL: https://www.uniprot.org/uniprotkb/P16109/entry pp. 1-12.
UniProtKB Accession No. P28906. Hematopoietic progenitor cell antigen CD34. Record created Dec. 1, 1992. Retrieved Aug. 16, 2024 at URL: https://www.uniprot.org/uniprotkb/P28906/entry pp. 1-10.
UniProtKB Accession No. P29459. Interleukin-12 subunit alpha. Record created Apr. 1, 1993. pp. 1-13. Retrieved Sep. 9, 2024 at URL: https://www.uniprot.org/uniprotkb/P29459/entry.
UniProtKB Accession No. P29460. Interleukin-12 subunit beta. Record created Apr. 1, 1993. pp. 1-10. Retrieved Sep. 9, 2024 at URL: https://www.uniprot.org/uniprotkb/P29460/entry.
UniProtKB Accession No. P30408. Transmembrane 4 L6 family member 1. Record created Apr. 1, 1993. Retrieved Aug. 16, 2024 at URL: https://www.uniprot.org/uniprotkb/P30408/entry pp. 1-7.
UniProtKB Accession No. P32881. Interferon alpha-8. Record created Oct. 1, 1993. pp. 1-7. Retrieved Sep. 9, 2024 at URL: https://www.uniprot.org/uniprotkb/P32881/entry.
UniProtKB Accession No. P36888. Receptor-type tyrosine-protein kinase FLT3. Record created Jun. 1, 1994. Retrieved Aug. 16, 2024 at URL: https://www.uniprot.org/uniprotkb/P36888/entry pp. 1-13.
UniProtKB Accession No. P36897. TGF-beta receptor type-1. Record created Jun. 1, 1994. Retrieved Aug. 16, 2024 at URL: https://www.uniprot.org/uniprotkb/P36897/entry pp. 1-16.
UniProtKB Accession No. P37173. TGF-beta receptor type-2. Record created Oct. 1, 1994. Retrieved Aug. 16, 2024 at URL: https://www.uniprot.org/uniprotkb/P37173/entry pp. 1-18.
UniProtKB Accession No. P40238. Thrombopoietin receptor. Record created Feb. 1, 1995. Retrieved Aug. 16, 2024 at URL: https://www.uniprot.org/uniprotkb/P40238/entry pp. 1-11.
UniProtKB Accession No. P40933. Interleukin-15. Record created Feb. 1, 1995. pp. 1-9. Retrieved Sep. 9, 2024 at URL: https://www.uniprot.org/uniprotkb/P40933/entry.
UniProtKB Accession No. P56856. CLD_HUMAN. 14 pages. Retrieved Oct. 7, 2024 at URL: https://www.uniprot.org/uniprotkb/P56856/entry.
UniProtKB Accession No. P60568. Interleukin-2. Record created Mar. 15, 2004. pp. 1-12. Retrieved Jul. 12, 2024 at URL: https://www.uniprot.org/uniprotkb/P60568/entry.
UniProtKB Accession No. P61812. Transforming growth factor beta-2 proprotein. Record created Jun. 7, 2004. Retrieved Aug. 16, 2024 at URL: https://www.uniprot.org/uniprotkb/P61812/entry pp. 1-12.
UniProtKB Accession No. Q02487. Desmocollin-2. Record created Feb. 1, 1994. Retrieved Aug. 16, 2024 at URL: https://www.uniprot.org/uniprotkb/Q02487/entry pp. 1-15.
UniProtKB Accession No. Q03167. Transforming growth factor beta receptor type 3. Record created Feb. 1, 1994. Retrieved Aug. 16, 2024 at URL: https://www.uniprot.org/uniprotkb/Q03167/entry pp. 1-10.
UniProtKB Accession No. Q14116. Interleukin-18. Record created Nov. 1, 1996. pp. 1-10. Retrieved Sep. 9, 2024 at URL: https://www.uniprot.org/uniprotkb/Q14116/entry.
UniProtKB Accession No. Q9H293. Interleukin-25. Record created Mar. 1, 2001. pp. 1-11. Retrieved Sep. 9, 2024 at URL: https://www.uniprot.org/uniprotkb/Q9H293/entry.
UniProtKB Accession No. Q9NPF7. Interleukin-23 subunit alpha. Record created Oct. 1, 2000. pp. 1-13. Retrieved Sep. 9, 2024 at URL: https://www.uniprot.org/uniprotkb/Q9NPF7/entry.
UniProtKB Accession No. Q9NYJ7. Delta-like protein 3. Record created Oct. 1, 2000. pp. 1-9. Retrieved Oct. 10, 2024 at URL: https://www.uniprot.org/uniprotkb/Q9NYJ7/entry.
Urakami, Akane. et al. An Envelope-Modified Tetravalent Dengue Virus-Like-Particle Vaccine Has Implications for Flavivirus Vaccine Design. Journal of virology 91(23):e00090-17, 1-16 (2017).
U.S. Appl. No. 15/465,564 Notice of Allowance dated Nov. 10, 2021.
U.S. Appl. No. 15/465,564 Notice of Allowance dated Oct. 29, 2021.
U.S. Appl. No. 15/465,564 Office Action dated Apr. 29, 2020.
U.S. Appl. No. 15/465,564 Office Action dated May 26, 2021.
U.S. Appl. No. 15/465,564 Office Action dated Oct. 13, 2020.
U.S. Appl. No. 15/465,564 Office Action dated Sep. 9, 2019.
U.S. Appl. No. 16/960,704 Office Action dated Dec. 22, 2023.
U.S. Appl. No. 16/960,704 Office Action dated Jul. 5, 2024.
U.S. Appl. No. 16/980,730 Notice of Allowance dated Jun. 13, 2024.
U.S. Appl. No. 16/980,730 Office Action dated Feb. 12, 2024.
U.S. Appl. No. 16/980,771 Office Action dated Jan. 10, 2024.
U.S. Appl. No. 17/256,917 Notice of Allowance dated Sep. 7, 2023.
U.S. Appl. No. 17/366,638 Office Action dated Apr. 25, 2024.
U.S. Appl. No. 17/366,638 Office Action dated Aug. 27, 2024.
U.S. Appl. No. 17/402,320 Office Action dated Dec. 12, 2024.
U.S. Appl. No. 17/402,322 Office Action dated Nov. 19, 2024.
U.S. Appl. No. 17/402,329 Office Action dated Nov. 5, 2024.
U.S. Appl. No. 17/529,017 Office Action dated Nov. 18, 2022.
U.S. Appl. No. 17/820,634 Office Action dated Apr. 19, 2023.
U.S. Appl. No. 17/820,634 Office Action dated Aug. 11, 2023.
U.S. Appl. No. 17/820,634 Office Action dated Aug. 15, 2023.
U.S. Appl. No. 17/820,794 Notice of Allowance dated Feb. 1, 2024.
U.S. Appl. No. 17/820,794 Office Action dated Dec. 29, 2023.
U.S. Appl. No. 17/820,794 Office Action dated Mar. 31, 2023.
U.S. Appl. No. 17/820,794 Office Action dated Sep. 15, 2023.
U.S. Appl. No. 17/820,800 Office Action dated Feb. 21, 2023.
U.S. Appl. No. 17/820,800 Office Action dated Jun. 1, 2023.
U.S. Appl. No. 17/820,805 Office Action dated Apr. 26, 2024.
U.S. Appl. No. 17/820,805 Office Action dated Aug. 14, 2023.
U.S. Appl. No. 17/820,805 Office Action dated Oct. 31, 2024.
U.S. Appl. No. 17/820,806 Office Action dated Apr. 12, 2023.
U.S. Appl. No. 17/820,806 Office Action dated Aug. 15, 2023.
U.S. Appl. No. 17/820,811 Office Action dated May 25, 2023.
U.S. Appl. No. 17/820,818 Office Action dated Jun. 1, 2023.
U.S. Appl. No. 17/820,818 Office Action dated Mar. 12, 2024.
U.S. Appl. No. 18/341,688 Office Action dated Jan. 25, 2024.
U.S. Appl. No. 18/341,688 Office Action dated May 10, 2024.
U.S. Appl. No. 18/472,920 Office Action dated Nov. 4, 2024.
Valkenburg, Sophie A. et al. Molecular Basis for Universal HLA-A*0201-restricted CD8+ T-cell Immunity Against Influenza Viruses. Proceedings of the National Academy of Sciences of the United States of America 113(16):4440-4445 (2016).
Van Dijk, Marc A. et al. Human Antibodies as Next Generation Therapeutics. Current Opinion in Chemical Biology 5(4):368-374 (2001).
Van Mierlo, Carlo PM, and Elles Steensma. Protein Folding and Stability Investigated by Fluorescence, Circular Dichroism (CD), and Nuclear Magnetic Resonance (NMR) Spectroscopy: the Flavodoxin Story. Journal of Biotechnology 79(3):281-298 (2000).
Van Rhijn, I. et al., "A conserved human T cell population targets mycobacterial antigens presented by CD1b," Nat Immunol., 2013;14(7):706-713.
Van Rhijn, I. et al., "TCR bias and affinity define two compartments of the CD1b-glycolipid-specific T Cell repertoire," J Immunol., 2014;192(9):4054-4060.
Vantourout, Pierre. et al. Innate TCRβ-chain engagement drives human T cells toward distinct memory-like effector phenotypes with immunotherapeutic potentials. Science Advances 9(49):eadj6174, 1-19 (2023).

(56) References Cited

OTHER PUBLICATIONS

Viney, Joanne L. et al. Generation of Monoclonal Antibodies Against a Human T Cell Receptor Beta Chain Expressed in Transgenic Mice. Hybridoma 11(6):701-713 (1992).
Vitetta, Ellen S. et al. Redesigning Nature's Poisons to Create Anti-tumor Reagents. Science 238(4830):1098-1104 (1987).
Vollmers, H P. et al. Death by Stress: Natural lgM-induced Apoptosis. Methods and Findings in Experimental and Clinical Pharmacology 27(3):185-191 (2005).
Vollmers, H P. et al. The "Early Birds": Natural lgM Antibodies and Immune Surveillance. Histology and Histopathology 20(3):927-937 (2005).
Walker, Laura M. et al. Broad and Potent Neutralizing Antibodies from an African Donor Reveal a New HIV-1 Vaccine Target. Science 326(5950):285-289 (2009).
Walker, Laura M. et al. Broad Neutralization Coverage of Hiv by Multiple Highly Potent Antibodies. Nature 477(7365):466-470 (2011).
Wang, Zhenguang. et al. Current status and perspectives of chimeric antigen receptor modified T cells for cancer treatment. Protein and Cell 8(12):896-925 (2017).
Ward, E Sally. et al. Binding Activities of a Repertoire of Single Immunoglobulin Variable Domains Secreted from *Escherichia coli*. Nature 341(6242):544-546 (1989).
Watanabe, M. et al. Interleukin-21 Can Efficiently Restore Impaired Antibody-dependent Cell-mediated Cytotoxicity in Patients With Oesophageal Squamous Cell Carcinoma. British Journal of Cancer 102(3):520-529 (2010).
Weisser, Nina E, and J Christopher Hall. Applications of single-chain variable fragment antibodies in therapeutics and diagnostics. Biotechnology advances 27(4):502-520 (2009).
Willemsen, R A. et al. Grafting Primary Human T Lymphocytes With Cancer-specific Chimeric Single Chain and Two Chain TCR. Gene Therapy 7(16):1369-1377 (2000).
Winkler et al., Changing the Antigen Binding Specificity by Single Point Mutations of an Anti-p24 (HIV-1) Antibody. Journal of Immunology 165(8):4505-4514 (2000).
Winter, Greg. et al. Making Antibodies by Phage Display Technology. Annual Review of Immunology 12(1):433-455 (1994).
Wright, Ann, and Sherie L. Morrison et al. Effect of Glycosylation on Antibody Function: Implications for Genetic Engineering. Trends in Biotechnology 15(1):26-32 (1997).
Xiang, Jianhua H. et al. Modification in Framework Region I Results in a Decreased Affinity of Chimeric Anti-TAG72 antibody. Molecular Immunology 28(1-2):141-148 (1991).
Xu, Jian. et al. MIR548P and TRAV39 Are Potential Indicators of Tumor Microenvironment and Novel Prognostic Biomarkers of Esophageal Squamous Cell Carcinoma. Journal of Clinical Oncology 2022:3152114, 1-20 (2022).
Yamane-Ohnuki, Naoko. et al. Establishment of FUT8 Knockout Chinese Hamster Ovary Cells: an Ideal Host Cell Line for Producing Completely Defucosylated Antibodies With Enhanced Antibody-dependent Cellular Cytotoxicity. Biotechnology and Bioengineering 87(5):614-622 (2004).
Yang, Xinbo. et al. Structural basis for clonal diversity of the human T-cell response to a dominant influenza virus epitope. J Biol Chem 292(45):18618-18627 (2017).
Yazaki, Paul J, and Anna M Wu. Expression of Recombinant Antibodies in Mammalian Cell Lines. Methods in Molecular Biology 248:255-268 (2004).
Yohannes, Dawit A. et al. Deep Sequencing of Blood and Gut T-cell Receptor B-chains Reveals Gluten-induced Immune Signatures in Celiac Disease. Scientific Reports 7(1):17977, 1-12 (2017).
Zhang, Tong. et al. An NKp30-Based Chimeric Antigen Receptor Promotes T cell Effector Functions and Antitumor Efficacy in Vivo. Journal of Immunology 189(5):2290-2299 (2012).
Zhang, Tong. et al. Transgenic TCR Expression: Comparison of Single Chain With Full-length Receptor Constructs for T-cell Function. Cancer Gene Therapy 11(7):487-496 (2004).
Zhou, Hongyu. et al. A Novel Risk Score System of Immune Genes Associated With Prognosis in Endometrial Cancer. Cancer Cell International 20:240, 1-12 (2020).
Zitti, et al. Natural killer cells in inflammation and autoimmunity. Cytokine & Growth Factor Reviews 42:37-46 (2018).

* cited by examiner

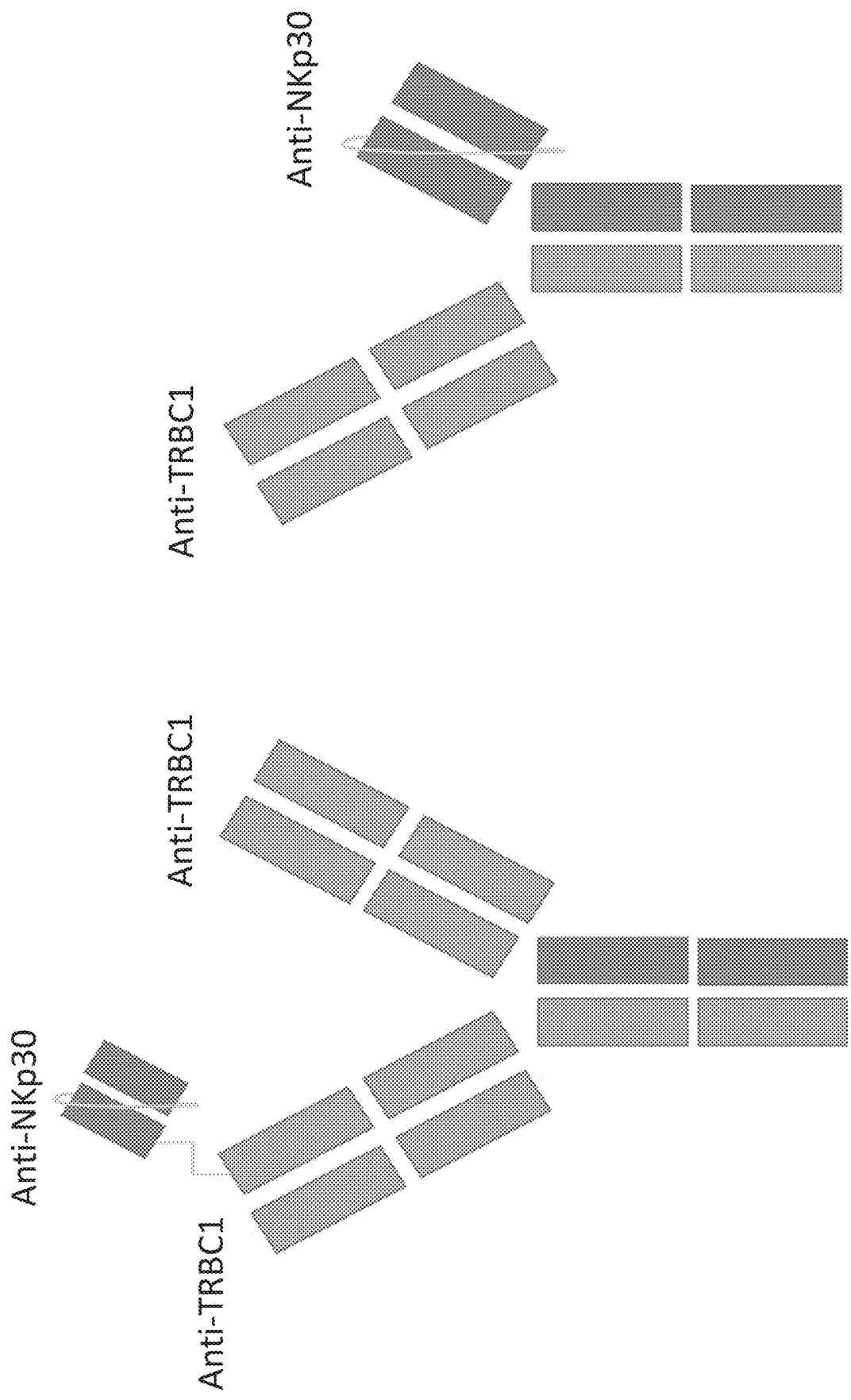

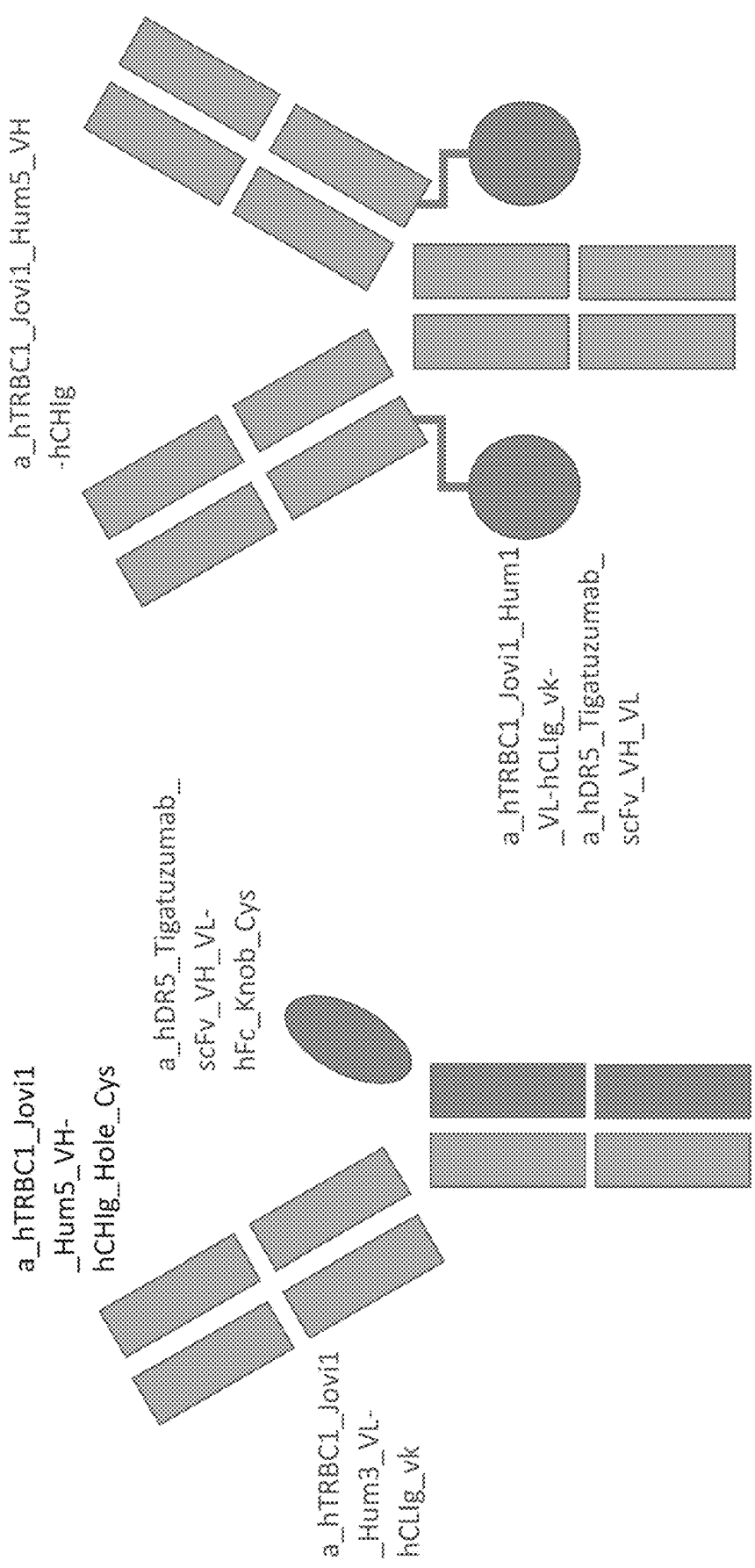

VH

Framework 1 / CDR 1 (positions 1–35):

| Position | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 |
|---|---|---|---|---|---|---|---|---|---|---|---|---|---|---|---|---|---|---|---|---|---|---|---|---|---|---|---|---|---|---|---|---|---|---|---|
| SEQ ID NO:1 | Q | V | Q | L | Q | Q | S | G | P | E | L | V | K | P | G | T | S | V | K | I | S | C | K | A | S | G | Y | S | F | T | T | Y | Y | I | H |
| SEQ ID NO:9 | Q | V | Q | L | V | Q | S | G | A | E | V | K | K | P | G | S | S | V | K | V | S | C | K | A | S | G | Y | S | F | T | T | Y | Y | I | H |

CDR1 spans positions 26–35.

Framework 2 / CDR 2 (positions 36–65):

| Position | 36 | 37 | 38 | 39 | 40 | 41 | 42 | 43 | 44 | 45 | 46 | 47 | 48 | 49 | 50 | 51 | 52 | 52a | 53 | 54 | 55 | 56 | 57 | 58 | 59 | 60 | 61 | 62 | 63 | 64 | 65 |
|---|---|---|---|---|---|---|---|---|---|---|---|---|---|---|---|---|---|---|---|---|---|---|---|---|---|---|---|---|---|---|---|
| SEQ ID NO:1 | W | V | K | Q | R | P | G | Q | G | L | E | W | I | G | W | F | F | P | G | S | G | N | I | K | Y | N | E | K | F | K | G |
| SEQ ID NO:9 | W | V | R | Q | A | P | G | Q | G | L | E | W | M | G | W | F | F | P | G | S | G | N | I | K | Y | N | E | K | F | K | G |

CDR2 spans positions 50–65.

Positions 66–94:

| Position | 66 | 67 | 68 | 69 | 70 | 71 | 72 | 73 | 74 | 75 | 76 | 77 | 78 | 79 | 80 | 81 | 82 | 82a | 82b | 82c | 83 | 84 | 85 | 86 | 87 | 88 | 89 | 90 | 91 | 92 | 93 | 94 |
|---|---|---|---|---|---|---|---|---|---|---|---|---|---|---|---|---|---|---|---|---|---|---|---|---|---|---|---|---|---|---|---|---|
| SEQ ID NO:1 | K | A | T | I | T | A | D | T | S | S | S | T | A | Y | M | Q | L | S | S | L | T | S | E | D | S | A | V | Y | Y | C | A | G |
| SEQ ID NO:9 | R | V | T | I | T | A | D | T | S | T | S | T | A | Y | M | E | L | S | S | L | R | S | E | D | T | A | V | Y | Y | C | A | G |

CDR 3 / Framework 4 (positions 95–113):

| Position | 95 | 96 | 97 | 98 | 99 | 100 | 100a | 100b | 101 | 102 | 103 | 104 | 105 | 106 | 107 | 108 | 109 | 110 | 111 | 112 | 113 |
|---|---|---|---|---|---|---|---|---|---|---|---|---|---|---|---|---|---|---|---|---|---|
| SEQ ID NO:1 | S | Y | Y | S | Y | D | V | L | D | Y | W | G | Q | G | T | T | L | T | V | S | S |
| SEQ ID NO:9 | S | Y | Y | S | Y | D | V | L | D | Y | W | G | Q | G | T | T | V | T | V | S | S |

CDR3 spans positions 95–102; Framework 4 spans positions 103–113.

Framework 1 / CDR1

| Position | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 |
|---|---|---|---|---|---|---|---|---|---|---|---|---|---|---|---|---|---|---|---|---|---|---|---|---|---|---|---|---|---|---|---|---|---|---|
| SEQ ID NO: 2 | D | I | L | M | T | Q | S | Q | K | F | M | S | T | S | L | G | D | R | V | S | V | T | C | K | A | S | Q | N | V | G | I | N | V | V |
| SEQ ID NO: 10 | D | I | Q | M | T | Q | S | P | S | F | L | S | A | S | V | G | D | R | V | T | I | T | C | K | A | S | Q | N | V | G | I | N | V | V |
| SEQ ID NO: 11 | D | I | Q | M | T | Q | S | P | S | L | L | S | A | S | V | G | D | R | V | T | I | T | C | K | A | S | Q | N | V | G | I | N | V | V |

Framework 2 / CDR2

| Position | 35 | 36 | 37 | 38 | 39 | 40 | 41 | 42 | 43 | 44 | 45 | 46 | 47 | 48 | 49 | 50 | 51 | 52 | 53 | 54 | 55 | 56 |
|---|---|---|---|---|---|---|---|---|---|---|---|---|---|---|---|---|---|---|---|---|---|---|
| SEQ ID NO: 2 | W | H | Q | Q | K | P | G | Q | S | P | K | A | L | I | Y | S | S | S | H | R | Y | S |
| SEQ ID NO: 10 | W | H | Q | Q | K | P | G | Q | K | P | K | A | L | I | Y | S | S | S | H | R | Y | S |
| SEQ ID NO: 11 | W | H | Q | Q | K | P | G | K | V | P | K | A | L | I | Y | S | S | S | H | R | Y | S |

Framework 3

| Position | 57 | 58 | 59 | 60 | 61 | 62 | 63 | 64 | 65 | 66 | 67 | 68 | 69 | 70 | 71 | 72 | 73 | 74 | 75 | 76 | 77 | 78 | 79 | 80 | 81 | 82 | 83 | 84 | 85 | 86 | 87 | 88 |
|---|---|---|---|---|---|---|---|---|---|---|---|---|---|---|---|---|---|---|---|---|---|---|---|---|---|---|---|---|---|---|---|---|
| SEQ ID NO: 2 | G | V | P | D | R | F | T | G | S | G | S | G | T | D | F | T | L | T | I | N | S | V | Q | S | E | D | L | A | E | Y | F | C |
| SEQ ID NO: 10 | G | V | P | S | R | F | S | G | S | G | S | G | T | E | F | T | L | T | I | S | S | L | Q | P | E | D | F | A | T | Y | F | C |
| SEQ ID NO: 11 | G | V | P | S | R | F | S | G | S | G | S | G | T | D | F | T | L | T | I | S | S | L | Q | P | E | D | V | A | T | Y | F | C |

CDR3 / Framework 4

| Position | 89 | 90 | 91 | 92 | 93 | 94 | 95 | 96 | 97 | 98 | 99 | 100 | 101 | 102 | 103 | 104 | 105 | 106 | 107 |
|---|---|---|---|---|---|---|---|---|---|---|---|---|---|---|---|---|---|---|---|
| SEQ ID NO: 2 | Q | Q | F | K | S | Y | P | L | T | F | G | A | G | T | K | L | E | L | K |
| SEQ ID NO: 10 | Q | Q | F | K | S | Y | P | L | T | F | G | Q | G | T | K | L | E | I | K |
| SEQ ID NO: 11 | Q | Q | F | K | S | Y | P | L | T | F | G | Q | G | T | K | L | E | I | K |

Framework 1 / CDR1

| Position | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 | 31 | 32 | 33 | 34 | 35 |
|---|---|---|---|---|---|---|---|---|---|---|---|---|---|---|---|---|---|---|---|---|---|---|---|---|---|---|---|---|---|---|---|---|---|---|---|
| SEQ ID NO: 15 | D | V | Q | L | V | E | S | G | G | G | L | V | Q | P | G | G | S | R | K | L | S | C | A | A | S | *G* | *F* | *T* | *F* | *S* | *N* | *F* | *G* | *M* | *H* |
| SEQ ID NO: 25 | Q | V | Q | L | V | E | S | G | G | G | L | V | Q | P | G | G | S | L | R | L | S | C | A | A | S | *G* | *F* | *T* | *F* | *S* | *N* | *F* | *G* | *M* | *H* |
| SEQ ID NO: 23 | E | V | Q | L | V | E | S | G | G | G | L | V | Q | P | G | G | S | L | R | L | S | C | A | A | S | *G* | *F* | *T* | *F* | *S* | *N* | *F* | *G* | *M* | *H* |
| SEQ ID NO: 24 | E | V | Q | L | V | E | S | G | G | G | L | V | Q | P | G | G | S | L | R | L | S | C | A | A | S | *G* | *F* | *T* | *F* | *S* | *N* | *F* | *G* | *M* | *H* |

Framework 2 / CDR2

| Position | 36 | 37 | 38 | 39 | 40 | 41 | 42 | 43 | 44 | 45 | 46 | 47 | 48 | 49 | 50 | 51 | 52 | 52a | 53 | 54 | 55 | 56 | 57 | 58 | 59 | 60 | 61 | 62 | 63 | 64 | 65 |
|---|---|---|---|---|---|---|---|---|---|---|---|---|---|---|---|---|---|---|---|---|---|---|---|---|---|---|---|---|---|---|---|
| SEQ ID NO: 15 | W | V | R | Q | A | P | G | K | G | L | E | W | V | A | *Y* | *I* | *S* | *S* | *G* | *S* | *S* | *T* | *I* | *Y* | *Y* | *A* | *D* | *T* | *L* | *K* | *G* |
| SEQ ID NO: 25 | W | V | R | Q | A | P | G | K | G | L | E | W | V | A | *Y* | *I* | *S* | *S* | *G* | *S* | *S* | *T* | *I* | *Y* | *Y* | *A* | *D* | *T* | *L* | *K* | *G* |
| SEQ ID NO: 23 | W | V | R | Q | A | P | G | K | G | L | E | W | V | S | *Y* | *I* | *S* | *S* | *G* | *S* | *S* | *T* | *I* | *Y* | *Y* | *A* | *D* | *T* | *L* | *K* | *G* |
| SEQ ID NO: 24 | W | V | R | Q | A | P | G | K | G | L | E | W | V | S | *Y* | *I* | *S* | *S* | *G* | *S* | *S* | *T* | *I* | *Y* | *Y* | *A* | *D* | *T* | *L* | *K* | *G* |

Framework 3

| Position | 66 | 67 | 68 | 69 | 70 | 71 | 72 | 73 | 74 | 75 | 76 | 77 | 78 | 79 | 80 | 81 | 82 | 82a | 82b | 82c | 83 | 84 | 85 | 86 | 87 | 88 | 89 | 90 | 91 | 92 | 93 | 94 |
|---|---|---|---|---|---|---|---|---|---|---|---|---|---|---|---|---|---|---|---|---|---|---|---|---|---|---|---|---|---|---|---|---|
| SEQ ID NO: 15 | R | F | T | I | S | R | D | N | S | K | N | T | L | Y | L | Q | M | N | S | L | R | A | E | D | T | A | M | Y | Y | C | A | R |
| SEQ ID NO: 25 | R | F | T | I | S | R | D | N | S | K | N | T | L | Y | L | Q | M | N | S | L | R | A | E | D | T | A | V | Y | Y | C | A | R |
| SEQ ID NO: 23 | R | F | T | I | S | R | D | N | A | K | N | T | L | Y | L | Q | M | N | S | L | R | A | E | D | T | A | V | Y | Y | C | A | R |
| SEQ ID NO: 24 | R | F | T | I | S | R | D | N | A | K | N | T | L | Y | L | Q | M | N | S | L | R | A | E | D | T | A | V | Y | Y | C | A | R |

CDR3 / Framework 4

| Position | 95 | 96 | 97 | 98 | 99 | 100 | 101 | 102 | 103 | 104 | 105 | 106 | 107 | 108 | 109 | 110 | 111 | 112 | 113 |
|---|---|---|---|---|---|---|---|---|---|---|---|---|---|---|---|---|---|---|---|
| SEQ ID NO: 15 | *R* | *G* | *E* | *G* | *A* | *M* | *D* | *Y* | W | G | Q | G | T | S | V | T | V | S | S |
| SEQ ID NO: 25 | *R* | *G* | *E* | *G* | *A* | *M* | *D* | *Y* | W | G | Q | G | T | T | V | T | V | S | S |
| SEQ ID NO: 23 | *R* | *G* | *E* | *G* | *A* | *M* | *D* | *Y* | W | G | Q | G | T | T | V | T | V | S | S |
| SEQ ID NO: 24 | *R* | *G* | *E* | *G* | *A* | *M* | *D* | *Y* | W | G | Q | G | T | T | V | T | V | S | S |

ELISA data showing direct binding of anti-TRBC1 mAbs (bivalent) to hTRBC1 coated on the plate Octet data showing binding of anti-TRBC1 Fabs to hTRBC1. hTRBC1 was captured on the sensor tip and dipped in solution containing different concentrations of monovalent Fabs

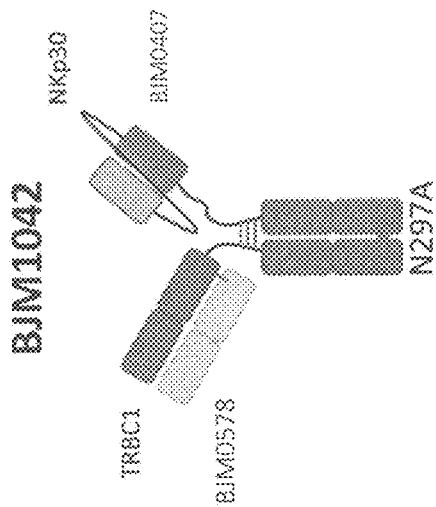
FIG. 11A BJM1052
FIG. 11B BJM1042
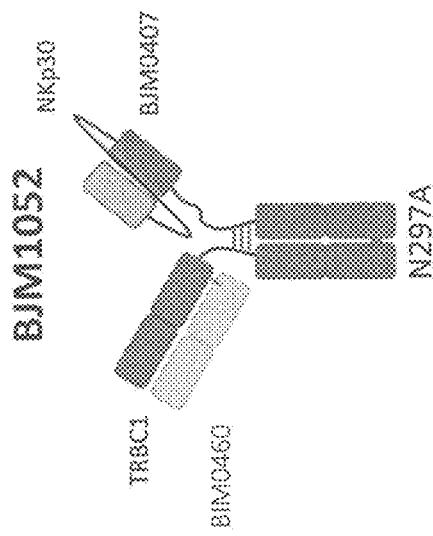
FIG. 11C BJM0889
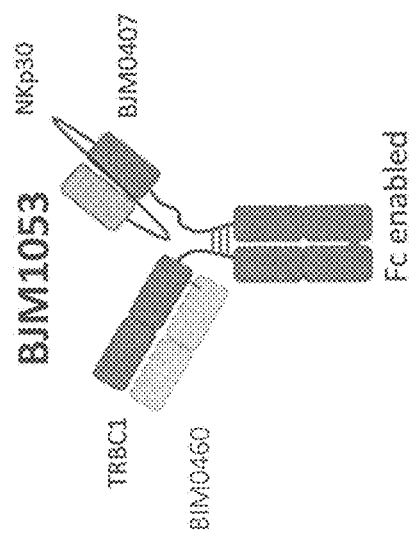
FIG. 11D BJM1083
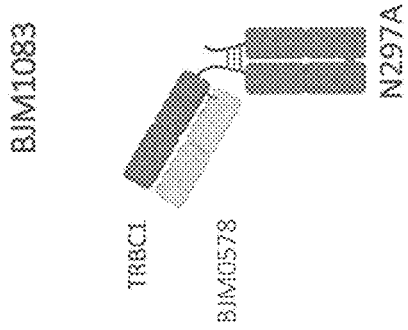
FIG. 11E BJM1053
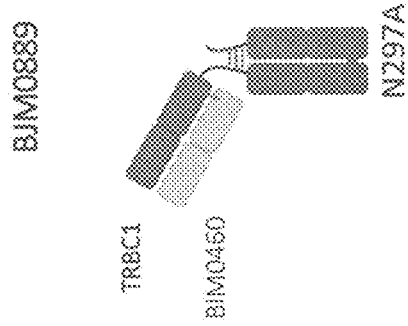

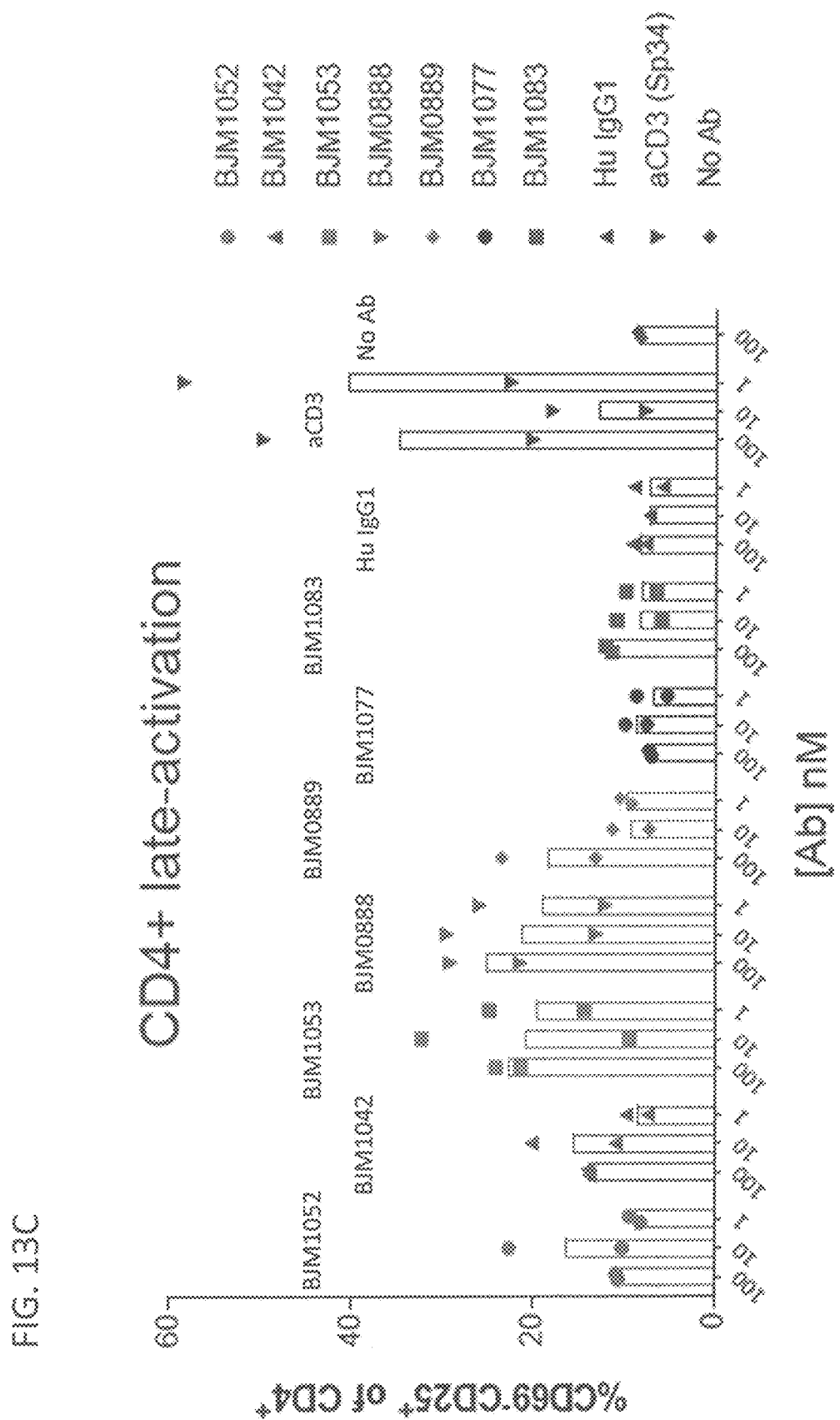

FIG. 15C

| | |
|---|---|
| BJM1048 | Nkp30/TRBC1 bispecific 407/460_N297A |
| BJM1051 | Nkp30/TRBC1 bispecific 407/460_WT |
| BJM1052 | Nkp30/TRBC1 bispecific 411/460_N297A |
| BJM1053 | Nkp30/TRBC1 bispecific 411/460_WT |
| BJM1032 | Nkp30/TRBC1 bispecific 407/578_WT |
| BJM1034 | Nkp30/TRBC1 bispecific 411/578_WT |
| BJM1038 | Nkp30/TRBC1 bispecific 407/578_N297A |
| BJM1042 | Nkp30/TRBC1 bispecific 411/578_N297A |
| BJM1077 | Nkp30 single arm control 411 N297A |
| BJM1078 | Nkp30 single arm control 407 WT |
| BJM1079 | Nkp30 single arm control 411 WT |
| BJM0888 | TRBC1 single arm WT 460 |
| BJM0889 | TRBC1 single arm N297A 460 |
| BJM1084 | TRBC1 578 Single arm control WT |
| BJM1083 | TRBC1 578 Single arm control N297A knob |

FIG. 15D

| | gMFI | |
|---|---|---|
| Sample | EC50 KHYG-1 (NKp30) (nM) | EC50 Jurkat (TRBC1) (nM) |
| BJM1048 | 7.656 | 8.288 |
| BJM1051 | 8.051 | 9.545 |
| BJM1052 | 6.608 | 4.554 |
| BJM1053 | 7.664 | 8.271 |
| BJM1032 | 7.494 | 70.99 |
| BJM1034 | 7.064 | 59.6 |
| BJM1038 | 7.989 | 60.48 |
| BJM1042 | 9.484 | 61.01 |
| BJM1077 | 4.947 | |
| BJM1078 | 5.2 | |
| BJM1079 | 5.357 | |
| BJM0888 | | 4.971 |
| BJM0889 | | 5.261 |
| BJM1084 | | 40.33 |
| BJM1083 | | 44.16 |

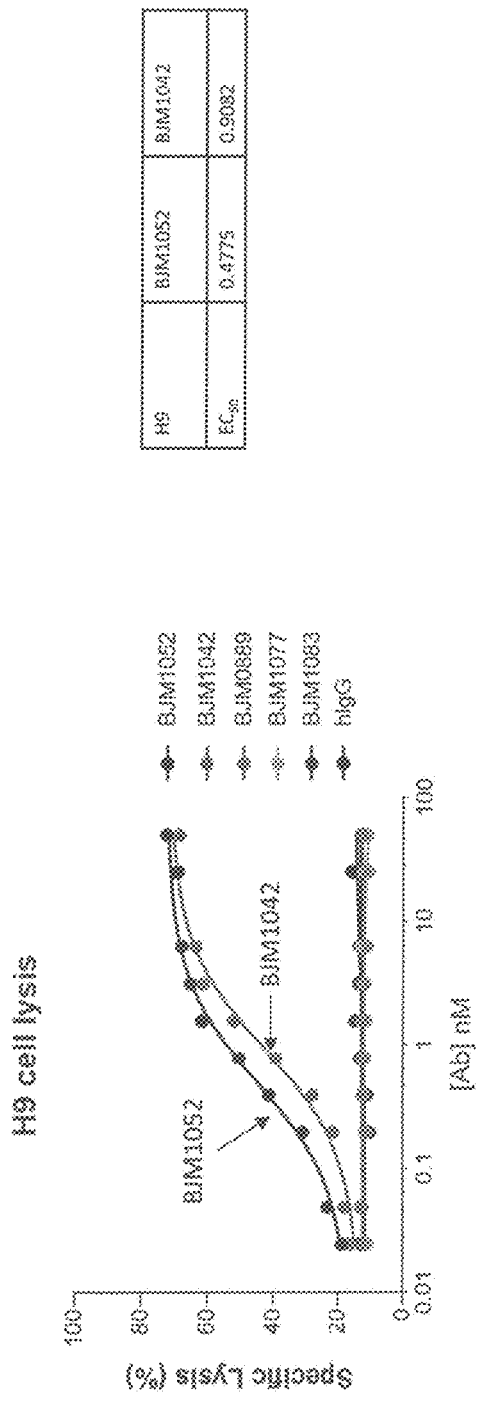
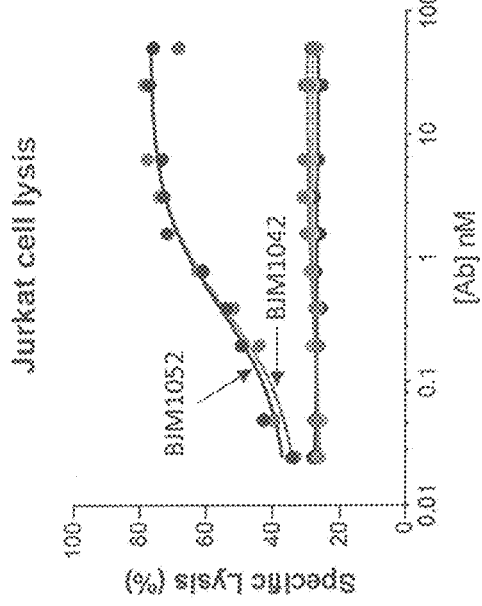
FIG. 16A
FIG. 16B

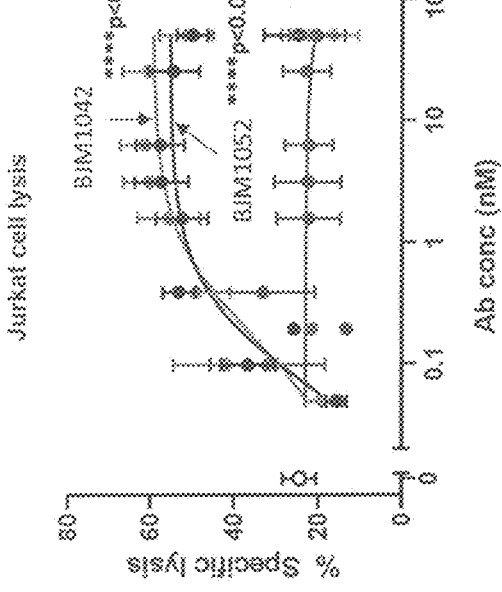
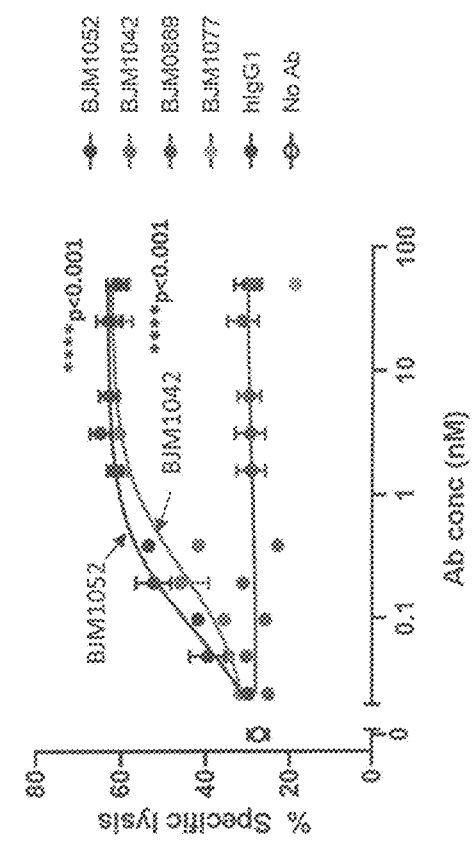
FIG. 17A
FIG. 17B

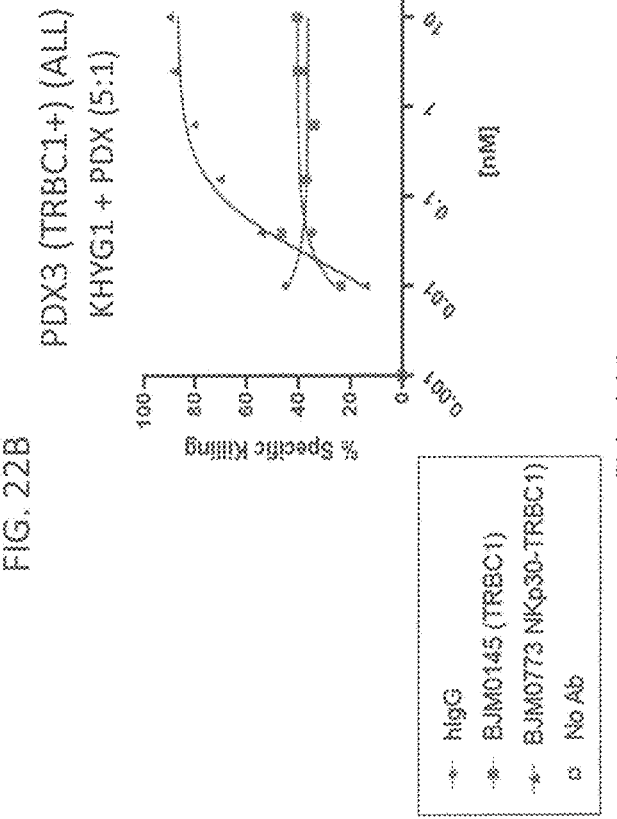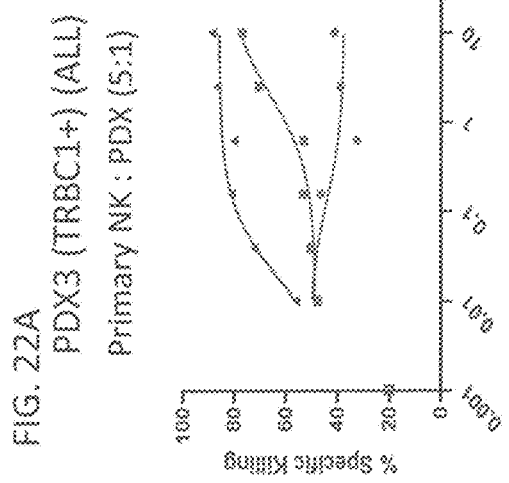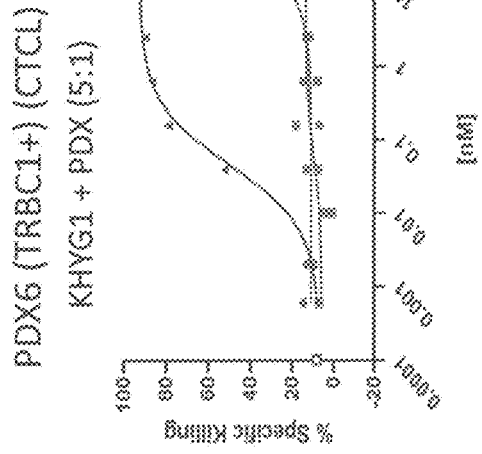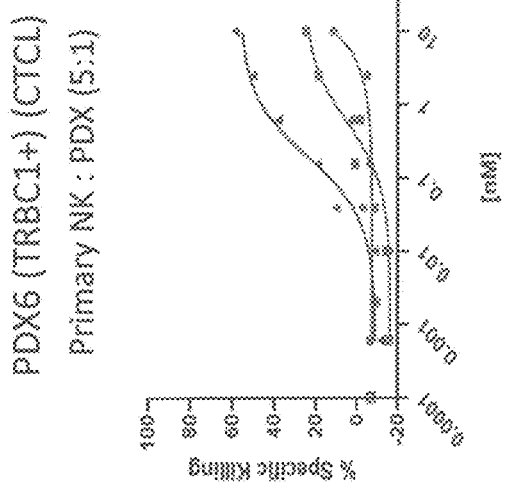
FIG. 22A PDX3 (TRBC1+) (ALL) Primary NK : PDX (5:1)
FIG. 22B PDX3 (TRBC1+) (ALL) KHYG1 + PDX (5:1)
FIG. 22C PDX6 (TRBC1+) (CTCL) Primary NK : PDX (5:1)
FIG. 22D PDX6 (TRBC1+) (CTCL) KHYG1 + PDX (5:1)

MULTIFUNCTIONAL MOLECULES THAT BIND TO T CELL RELATED CANCER CELLS AND USES THEREOF

RELATED APPLICATIONS

This application is a continuation of International Application No. PCT/US2020/019291, filed on Feb. 21, 2020, which claims the benefit of U.S. Provisional Patent Application No. 62/808,646 filed on Feb. 21, 2019, the entire contents of each of which are hereby incorporated by reference.

SEQUENCE LISTING

The instant application contains a Sequence Listing which has been submitted electronically in ASCII format and is hereby incorporated by reference in its entirety. Said ASCII copy, created on Feb. 19, 2020, is named 53676-732.301_SL.txt and is 810,998 bytes in size.

BACKGROUND

Lymphomas are cancers that arise from lymphocytes. T cell lymphoma (TCL) is a lymphoma that arises from T cells; these account for approximately 7% of all non-Hodgkin's lymphomas in the United States. Common subtypes of TCL include: Peripheral T Cell Lymphoma, Not Otherwise Specified (PTCLNOS), Anaplastic Large Cell Lymphoma (ALCL), Angioimmunoblastic T Cell Lymphoma (AITL), and Cutaneous T Cell Lymphoma (CTCL). Each type of TCL has its own pathology and symptoms. Given the ongoing need for improved treatment of lymphomas such as TCLs, new compositions and treatments targeting lymphomas, e.g., TCLs, are highly desirable.

SUMMARY OF THE INVENTION

The disclosure relates, inter alia, to novel multispecific or multifunctional molecules that include (i) an antigen binding domain that binds to a tumor antigen on a lymphoma cell (e.g., a T cell), e.g., a T cell receptor comprising T cell receptor beta chain constant domain 1 (TRBC1) or a T cell receptor comprising T cell receptor beta chain constant domain 2 (TRBC2); and one, two or all of: (ii) an immune cell engager (e.g., chosen from an NK cell engager, a T cell engager, a B cell engager, a dendritic cell engager, or a macrophage cell engager); (iii) a cytokine molecule; and/or (iv) a stromal modifying moiety. The terms "multispecific" or "multifunctional" are used interchangeably herein.

Without wishing to be bound by theory, the multispecific or multifunctional molecules disclosed herein are expected to target (e.g., localize, bridge and/or activate) an immune cell (e.g., an immune effector cell chosen from an NK cell, a T cell, a B cell, a dendritic cell or a macrophage), at a target cell, e.g., a cancer cell (e.g., a lymphoma cell), expressing a T cell receptor comprising TRBC1 or TRBC2, and/or alter the tumor stroma, e.g., alter the tumor microenvironment near the cancer site. Increasing the proximity and/or activity of the immune cell using the multispecific molecules described herein is expected to enhance an immune response against the target cell (e.g., the cancer cell, e.g., lymphoma cell), thereby providing a more effective therapy (e.g., a more effective cancer therapy). Without being bound by theory, a targeted, localized immune response against the target cell (e.g., the cancer cell) is believed to reduce the effects of systemic toxicity of the multispecific molecules described herein.

Furthermore, in the case where the target cancer cell is a T cell (e.g., a T cell expressing a T cell receptor comprising TRBC1 or TRBC2), a targeted immune response against the cancerous T cell population that targets non-cancerous T cells to a lesser degree (e.g., does not target non-cancerous T cells) is believed to have fewer deleterious effects than systemic ablation of all T cells.

Without wishing to be bound by theory, clonally derived T cell lymphomas are positive for either TRBC1 or TRBC2, but not both. In the case of TRBC1+ T cell malignancies, an anti-TRBC1 molecule disclosed herein (e.g., a multifunctional molecule that binds to TRBC1 and NKp30) may deplete TRBC1+ cells while sparing TRBC2+ non-malignant T cells. Similarly, in the case of TRBC2+ T cell malignancies, an anti-TRBC2 molecule disclosed herein (e.g., a multifunctional molecule that binds to TRBC2 and NKp30) may deplete TRBC2+ cells while sparing TRBC1+ non-malignant T cells.

Without wising to be bound by theory, in some embodiments, a multifunctional molecule disclosed herein (e.g., anti-TRBC1/NKp30 antibody) only activates NK cells in the presence of a TRBC1-expressing cell. Without wising to be bound by theory, in some embodiments, a multifunctional molecule disclosed herein (e.g., anti-TRBC2/NKp30 antibody) only activates NK cells in the presence of a TRBC2-expressing cell.

Accordingly, provided herein are, inter alia, multispecific molecules (e.g., multispecific or multifunctional antibody molecules) that include the aforesaid moieties, nucleic acids encoding the same, methods of producing the aforesaid molecules, and methods of treating a cancer using the aforesaid molecules.

In one aspect, provided herein is a multifunctional molecule comprising (i) a first antigen binding domain that binds to T cell receptor beta chain constant domain 1 (TRBC1) or T cell receptor beta chain constant domain 2 (TRBC2), and (ii) a second antigen binding domain that binds to NKp30.

In some embodiments, the first antigen binding domain binds to TRBC1. In some embodiments, the first antigen binding domain comprises one or more CDRs, framework regions, variable regions, or antigen binding domains disclosed in any of Tables 2-6 and 19, or a sequence having at least 85%, 90%, 95%, or 99% identity thereto. In some embodiments, the first antigen binding domain comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3, wherein the VHCDR1, VHCDR2, and VHCDR3 comprise the amino acid sequences of: SEQ ID NOs: 7346, 7355, and 202, respectively; SEQ ID NOs: 7346, 201, and 202, respectively; SEQ ID NOs: 7354, 201, and 202, respectively; or SEQ ID NOs: 7354, 7355, and 202, respectively. In some embodiments, the VLCDR1, VLCDR2, and VLCDR3 comprise the amino acid sequences of: SEQ ID NOs: 223, 224, and 225, respectively; SEQ ID NOs: 7367, 224, and 225, respectively; SEQ ID NOs: 223, 7368, and 225, respectively; SEQ ID NOs: 223, 224, and 7369, respectively; or SEQ ID NOs: 7367, 7368, and 7369, respectively. In some embodiments, the VHCDR1, VHCDR2, VHCDR3, VLCDR1, VLCDR2, and VLCDR3 comprise the amino acid sequences of: SEQ ID NOs: 7346, 7355, 202, 223, 224, and 225, respectively; SEQ ID NOs: 7346, 201, 202, 223, 224, and 225, respectively; SEQ ID NOs: 7346, 7355, 202, 7367, 224, and 225, respectively; SEQ ID NOs: 7346, 7355, 202, 223, 7368, and 225, respectively; SEQ ID NOs: 7346, 7355, 202, 223, 224, and 7369, respectively; SEQ ID NOs: 7346, 7355, 202, 7367, 7368, and 7369, respectively; SEQ ID NOs: 7346, 201, 202, 7367, 224, and 225, respectively; SEQ ID NOs: 7346, 201, 202, 223, 7368, and 225, respectively; SEQ ID NOs: 7346, 201, 202, 223, 224, and 7369, respectively; SEQ ID NOs: 7346, 201, 202, 7367, 7368, and 7369, respectively; SEQ ID NOs: 7354, 201, 202, 223, 224, and 225, respectively; SEQ ID NOs: 7354, 201, 202, 7367, 224, and 225, respectively; SEQ ID NOs: 7354, 201, 202, 223, 7368, and 225, respectively; SEQ ID NOs: 7354, 201, 202, 223, 224, and 7369, respectively; SEQ ID NOs: 7354, 201, 202, 7367, 7368, and 7369, respectively; SEQ ID NOs: 7354, 7355, 202, 223, 224, and 225, respectively; SEQ ID NOs: 7354, 7355, 202, 7367, 224, and 225, respectively; SEQ ID NOs: 7354, 7355, 202, 223, 7368, and 225, respectively; SEQ ID NOs: 7354, 7355, 202, 223, 224, and 7369, respectively; or SEQ ID NOs: 7354, 7355, 202, 7367, 7368, and 7369, respectively. In some embodiments, the VH comprises an amino acid sequence selected from the group consisting of SEQ ID NOs: 7351, 253, 250-252, 254, 7343, 7344, 7350, and 7352 (or a sequence having at least 85%, 90%, 95%, or 99% identity thereto) and/or the VL comprises an amino acid sequence selected from the group consisting of SEQ ID NOs: 258, 255-257, 259, 260, and 7357-7360 (or a sequence having at least 85%, 90%, 95%, or 99% identity thereto). In some embodiments, the VH and VL comprise the amino acid sequences of: SEQ ID NOs: 7351 and 258, respectively (or a sequence having at least 85%, 90%, 95%, or 99% identity thereto); or SEQ ID NOs: 253 and 258, respectively (or a sequence having at least 85%, 90%, 95%, or 99% identity thereto).

In some embodiments, the first antigen binding domain has a higher affinity for a T cell receptor comprising TRBC1 than for T cell receptors not comprising TRBC1, optionally wherein the KD for the binding between the first antigen binding domain and TRBC1 is no more than 40%, 30%, 20%, 10%, 1%, 0.1%, or 0.01% of the KD for the binding between the first antigen binding domain and a T cell receptor not comprising TRBC1. In some embodiments, the first antigen binding domain has a higher affinity for a T cell receptor comprising TRBC1 than for T cell receptors comprising TRBC2, optionally wherein the KD for the binding between the first antigen binding domain and TRBC1 is no more than 40%, 30%, 20%, 10%, 1%, 0.1%, or 0.01% of the KD for the binding between the first antigen binding domain and a T cell receptor comprising TRBC2. In some embodiments, binding of the first antigen binding domain to TRBC1 on a lymphoma cell or lymphocyte, e.g., T cell, does not appreciably activate the lymphoma cell or lymphocyte, e.g., T cell, (e.g., as measured by T cell proliferation, expression of a T cell activation marker (e.g., CD69 or CD25), and/or expression of a cytokine (e.g., TNFα and IFNγ). In some embodiments, the multifunctional molecule does not activate NK cells or does not substantially activate NK cells in the absence of a TRBC1-expressing cell.

In some embodiments, the first antigen binding domain binds to TRBC2. In some embodiments, the first antigen binding domain has a higher affinity for a T cell receptor comprising TRBC2 than for T cell receptors not comprising TRBC2, optionally wherein the KD for the binding between the first antigen binding domain and TRBC2 is no more than 40%, 30%, 20%, 10%, 1%, 0.1%, or 0.01% of the KD for the binding between the first antigen binding domain and a T cell receptor not comprising TRBC2. In some embodiments, the first antigen binding domain has a higher affinity for a T cell receptor comprising TRBC2 than for T cell receptors comprising TRBC1, optionally wherein the KD for the binding between the first antigen binding domain and TRBC2 is no more than 40%, 30%, 20%, 10%, 1%, 0.1%, or 0.01% of the KD for the binding between the first antigen binding domain and a T cell receptor comprising TRBC1. In some embodiments, binding of the first antigen binding domain to TRBC2 on a lymphoma cell or lymphocyte, e.g., T cell, does not appreciably activate the lymphoma cell or lymphocyte, e.g., T cell, (e.g., as measured by T cell proliferation, expression of a T cell activation marker (e.g., CD69 or CD25), and/or expression of a cytokine (e.g., TNFα and IFNγ). In some embodiments, the multifunctional molecule does not activate NK cells or does not substantially activate NK cells in the absence of a TRBC2-expressing cell.

In some embodiments, the second antigen binding domain comprises one or more CDRs, framework regions, variable regions, or antigen binding domains disclosed in any of Tables 7-10, 18, and 19, or a sequence having at least 85%, 90%, 95%, or 99% identity thereto.

In some embodiments, the second antigen binding domain comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3, wherein the VHCDR1, VHCDR2, and VHCDR3 of the second antigen binding domain comprise the amino acid sequences of: SEQ ID NOs: 7313, 6001, and 7315, respectively; SEQ ID NOs: 7313, 6001, and 6002, respectively; SEQ ID NOs: 7313, 6008, and 6009, respectively; SEQ ID NOs: 7313, 7385, and 7315, respectively; or SEQ ID NOs: 7313, 7318, and 6009, respectively. In some embodiments, the VLCDR1, VLCDR2, and VLCDR3 of the second antigen binding domain comprise the amino acid sequences of: SEQ ID NOs: 7326, 7327, and 7329, respectively; SEQ ID NOs: 6063, 6064, and 7293, respectively; SEQ ID NOs: 6070, 6071, and 6072, respectively; or SEQ ID NOs: 6070, 6064, and 7321, respectively. In some embodiments, the VHCDR1, VHCDR2, VHCDR3, VLCDR1, VLCDR2, and VLCDR3 of the second antigen binding domain comprise the amino acid sequences of: SEQ ID NOs: 7313, 6001, 7315, 7326, 7327, and 7329, respectively; SEQ ID NOs: 7313, 6001, 6002, 6063, 6064, and 7293, respectively; SEQ ID NOs: 7313, 6008, 6009, 6070, 6071, and 6072, respectively; SEQ ID NOs: 7313, 7385, 7315, 6070, 6064, and 7321, respectively; or SEQ ID NOs: 7313, 7318, 6009, 6070, 6064, and 7321, respectively. In some embodiments, the VH of the second antigen binding domain comprises an amino acid sequence selected from the group consisting of SEQ ID NOs: 7302, 7298, 7300, 7301, 7303, and 7304 (or a sequence having at least 85%, 90%, 95%, or 99% identity thereto) and/or the VL of the second antigen binding domain comprises an amino acid sequence selected from the group consisting of SEQ ID NOs: 7309, 7305, 7299, 7306-7308 (or a sequence having at least 85%, 90%, 95%, or 99% identity thereto). In some embodiments, the VH of the second antigen binding domain comprises an amino acid sequence selected from the group consisting of SEQ ID NOs: 6121 or 6123-6128 (or a sequence having at least 85%, 90%, 95%, or 99% identity thereto) and/or the VL of the second antigen binding domain comprises an amino acid sequence selected from the group consisting of SEQ ID NOs: 7294 or 6137-6141 (or a sequence having at least 85%, 90%, 95%, or 99% identity thereto). In some embodiments, the VH of the second antigen binding domain comprises an amino acid sequence selected from the group consisting of SEQ ID NOs: 6122 or 6129-6134 (or a sequence having at least 85%, 90%, 95%, or 99% identity thereto) and/or the VL of the second antigen binding domain comprises an amino acid sequence selected from the group consisting of SEQ ID NOs: 6136 or 6142-6147 (or a sequence having at least 85%, 90%, 95%, or 99% identity thereto). In some embodiments, the VH and VL of the second antigen binding domain comprise the amino acid sequences of: SEQ ID NOs: 7302 and 7309, respectively (or a sequence having at least 85%, 90%, 95%, or 99% identity thereto); or SEQ ID NOs: 7302 and 7305, respectively (or a sequence having at least 85%, 90%, 95%, or 99% identity thereto). In some embodiments, the second antigen binding domain comprise the amino acid sequences of: SEQ ID NO: 7311 or 7310 (or a sequence having at least 85%, 90%, 95%, or 99% identity thereto); SEQ ID NO: 6187 or 6188 (or a sequence having at least 85%, 90%, 95%, or 99% identity thereto); or SEQ ID NO: 6189 or 6190 (or a sequence having at least 85%, 90%, 95%, or 99% identity thereto).

In some embodiments, the multifunctional molecule binds to TRBC1 or TRBC2 monovalently. In some embodiments, the multifunctional molecule comprises a configuration shown in any of FIGS. 29A-29D, optionally wherein: (i) the multifunctional antibody molecule comprises an anti-TRBC1 Fab and an anti-NKp30 scFv, e.g., comprises a configuration shown in FIG. 29A; (ii) the multifunctional antibody molecule comprises an anti-TRBC1 Fab and an anti-NKp30 Fab, e.g., comprises a configuration shown in FIG. 29B; (iii) the multifunctional antibody molecule comprises an anti-NKp30 Fab and an anti-TRBC1 scFv, e.g., comprises a configuration shown in FIG. 29C; or (iv) the multifunctional antibody molecule comprises an anti-TRBC1 scFv and an anti-NKp30 scFv, e.g., comprises a configuration shown in FIG. 29D.

In some embodiments, the multifunctional molecule comprises a configuration shown in any of FIGS. 30A-30D, optionally wherein: (i) the multifunctional antibody molecule comprises an anti-TRBC2 Fab and an anti-NKp30 scFv, e.g., comprises a configuration shown in FIG. 30A; (ii) the multifunctional antibody molecule comprises an anti-TRBC2 Fab and an anti-NKp30 Fab, e.g., comprises a configuration shown in FIG. 30B; (iii) the multifunctional antibody molecule comprises an anti-NKp30 Fab and an anti-TRBC2 scFv, e.g., comprises a configuration shown in FIG. 30C; or (iv) the multifunctional antibody molecule comprises an anti-TRBC2 scFv and an anti-NKp30 scFv, e.g., comprises a configuration shown in FIG. 30D.

In some embodiments, a multifunctional molecule disclosed herein further comprises a dimerization module comprising one or more immunoglobulin chain constant regions (e.g., Fc regions) comprising one or more of: a paired cavity-protuberance ("knob-in-a hole"), an electrostatic interaction, or a strand-exchange.

In some embodiments, the multifunctional molecule comprises an anti-TRBC1 amino acid sequence disclosed in any of Tables 2-6 and 19, or a sequence having at least 85%, 90%, 95%, or 99% identity thereto, and/or an anti-NKp30 amino acid sequence disclosed in any of Tables 7-10, 18, and 19, or a sequence having at least 85%, 90%, 95%, or 99% identity thereto. In some embodiments, the multifunctional molecule comprises: (i) an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto); (ii) an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7311 (or a sequence having at least 85%, 90%, 95%, or 99% identity thereto); or (iii) SEQ ID NOs: 7382, 7380, and 7383 (or a sequence having at least 85%, 90%, 95%, or 99% identity thereto). In some embodiments, the multifunctional molecule comprises: (i) an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto); (ii) an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7311 (or a sequence having at least 85%, 90%, 95%, or 99% identity thereto); or (iii) SEQ ID NOs: 7379, 7380, and 7383 (or a sequence having at least 85%, 90%, 95%, or 99% identity thereto). In some embodiments, the multifunctional molecule comprises: (i) an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7305 (or a sequence having at least 85%, 90%, 95%, or 99% identity thereto); (ii) an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7310 (or a sequence having at least 85%, 90%, 95%, or 99% identity thereto); or (iii) SEQ ID NOs: 7382, 7380, and 7384 (or a sequence having at least 85%, 90%, 95%, or 99% identity thereto). In some embodiments, the multifunctional molecule comprises: (i) an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7305 (or a sequence having at least 85%, 90%, 95%, or 99% identity thereto); (ii) an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7310 (or a sequence having at least 85%, 90%, 95%, or 99% identity thereto); or (iii) SEQ ID NOs: 7379, 7380, and 7384 (or a sequence having at least 85%, 90%, 95%, or 99% identity thereto).

In some embodiments, the multifunctional molecule comprises: a heavy chain constant region variant, e.g., an Fc region variant, that comprises one or more mutations that result in reduced or ablated affinity for at least one Fc receptor, optionally wherein the one or more mutations result in reduced or ablated antibody dependent cell-mediated cytotoxicity (ADCC), Antibody-dependent cellular phagocytosis (ADCP), or complement dependent cytotoxicity (CDC). In some embodiments, the Fc region variant comprises one or more mutations disclosed in Table 20, optionally wherein the Fc region variant comprises an N297A mutation.

In one aspect, provided herein is an antibody molecule that binds to TRBC1, comprising one or more CDRs, framework regions, variable regions, or antigen binding domains disclosed in any of Tables 2-6 and 19, or a sequence having at least 85%, 90%, 95%, or 99% identity thereto.

In one aspect, provided herein is an antibody molecule that binds to NKp30, comprising one or more CDRs, framework regions, variable regions, or antigen binding domains disclosed in any of Tables 7-10, 18, and 19, or a sequence having at least 85%, 90%, 95%, or 99% identity thereto.

In some embodiments, the antibody molecule comprises a heavy chain constant region variant, e.g., an Fc region variant, that comprises one or more mutations that result in reduced or ablated affinity for at least one Fc receptor, optionally wherein the one or more mutations result in reduced or ablated antibody dependent cell-mediated cytotoxicity (ADCC), Antibody-dependent cellular phagocytosis (ADCP), or complement dependent cytotoxicity (CDC). In some embodiments, the Fc region variant comprises one or more mutations disclosed in Table 20, optionally wherein the Fc region variant comprises an N297A mutation.

In one aspect, provide herein is a nucleic acid molecule encoding a multifunctional molecule disclosed herein or an antibody molecule disclosed herein. In one aspect, provide herein is a vector, e.g., an expression vector, comprising a nucleic acid molecule disclosed herein. In one aspect, provide herein is a cell comprising a nucleic acid molecule disclosed herein or a vector disclosed herein. In one aspect, provide herein is a pharmaceutical composition comprising a multifunctional molecule disclosed herein or an antibody molecule disclosed herein and a pharmaceutically acceptable carrier, excipient, or stabilizer.

In one aspect, provide herein is a method of making, e.g., producing, a multifunctional molecule disclosed herein or an antibody molecule disclosed herein, comprising culturing a cell disclosed herein, under suitable conditions, e.g., conditions suitable for gene expression and/or homo- or heterodimerization.

In one aspect, provide herein is a method of treating a cancer, comprising administering to a subject in need thereof a multifunctional molecule disclosed herein or an antibody molecule disclosed herein, wherein the multifunctional molecule or antibody molecule is administered in an amount effective to treat the cancer. In some embodiments, the method further comprises identifying, evaluating, or selecting a subject in need of treatment, wherein identifying, evaluating, or selecting comprises determining (e.g., directly determining or indirectly determining, e.g., obtaining information regarding) whether a subject has cancer cells that express a T cell receptor comprising TRBC1 or TRBC2. In some embodiments, the method further comprises: responsive to a determination that a subject has cancer cells that express a T cell receptor comprising TRBC1: optionally, selecting the subject for treatment with a multifunctional molecule comprising an antigen binding domain that binds to a T cell receptor comprising TRBC1, and administering a multifunctional molecule disclosed herein comprising an antigen binding domain that binds to a T cell receptor comprising TRBC1. In some embodiments, the method further comprises: responsive to a determination that a subject has cancer cells that express a T cell receptor comprising TRBC2: optionally, selecting the subject for treatment with a multifunctional molecule comprising an antigen binding domain that binds to a T cell receptor comprising TRBC2, and administering a multifunctional molecule disclosed herein comprising an antigen binding domain that binds to a T cell receptor comprising TRBC2.

In one aspect, provide herein is a method of treating a cancer, e.g., a lymphoma or leukemia, e.g., a T cell lymphoma or leukemia, comprising: responsive to a determination that a subject has cancer cells that express a T cell receptor comprising TRBC1, administering to the subject a multifunctional molecule disclosed herein, wherein the first antigen binding domain of the multifunctional molecule binds to TRBC1, wherein the multifunctional molecule is administered in an amount effective to treat the cancer. In one aspect, provide herein is a method of treating a cancer, e.g., a lymphoma or leukemia, e.g., a T cell lymphoma or leukemia, comprising: responsive to a determination that a subject has cancer cells that express a T cell receptor comprising TRBC2, administering to the subject a multifunctional molecule disclosed herein, wherein the first antigen binding domain of the multifunctional molecule binds to TRBC2, wherein the multifunctional molecule is administered in an amount effective to treat the cancer.

In one aspect, provide herein is a method of identifying a subject in need of treatment for cancer, e.g., a lymphoma or leukemia, e.g., a T cell lymphoma or leukemia, using a multifunctional molecule disclosed herein, comprising determining (e.g., directly determining or indirectly determining, e.g., obtaining information regarding) whether a subject has cancer cells that express a T cell receptor comprising TRBC1 or TRBC2, wherein:
responsive to a determination that the subject has cancer cells that express a T cell receptor comprising TRBC1, identifying the subject as a candidate for treatment using a multifunctional molecule comprising an antigen binding domain that binds to TRBC1, and optionally not as a candidate for treatment using a multifunctional molecule comprising an antigen binding domain that binds to TRBC2, or
responsive to a determination that the subject has cancer cells that express a T cell receptor comprising TRBC2, identifying the subject as a candidate for treatment using a multifunctional molecule comprising an antigen binding domain that binds to TRBC2, and optionally not as a candidate for treatment using a multifunctional molecule comprising an antigen binding domain that binds to TRBC1.

In some embodiments, the method further comprises:
responsive to identifying the subject as a candidate for treatment using a multifunctional molecule comprising an antigen binding domain that binds to TRBC1, treating the subject with (e.g., administering to the subject) a multifunctional molecule comprising an antigen binding domain that binds to TRBC1, or
responsive to identifying the subject as a candidate for treatment using a multifunctional molecule comprising an antigen binding domain that binds to TRBC2, treating the subject with (e.g., administering to the subject) a multifunctional molecule comprising an antigen binding domain that binds to TRBC2.

In some embodiments of the aforementioned methods, the cancer is leukemia or lymphoma. In some embodiments, the cancer is selected from Acquired immune deficiency syndrome (AIDS)-associated lymphoma, Angioimmunoblastic T-cell lymphoma, Adult T-cell leukemia/lymphoma, Burkitt lymphoma, Central nervous system (CNS) lymphoma, Diffuse large B-cell lymphoma (DLBCL), Lymphoblastic lymphoma, Mantle cell lymphoma (MCL), Peripheral T-cell lymphoma (PTCL) (e.g., Hepatosplenic T-cell lymphoma (HSGDTCL), Subcutaneous paniculitis-like T-cell lymphoma, or Enteropathy-associated T-cell lymphoma), Transformed follicular and transformed mucosa-associated lymphoid tissue (MALT) lymphomas, Cutaneous T-cell lymphoma (mycosis fungoides and Sezary syndrome), Follicular lymphoma, Lymphoplasmacytic lymphoma/Waldenstrom macroglobulinemia, Marginal zone B-cell lymphoma, Gastric mucosa-associated lymphoid tissue (MALT) lymphoma, Chronic lymphocytic leukemia/small-cell lymphocytic lymphoma (CLL/SLL), Extranodal T-/NK-cell lymphoma (nasal type), and Anaplastic large-cell lymphoma (e.g., primary cutaneous anaplastic large-cell lymphoma or systemic anaplastic large-cell lymphoma). In some embodiments, the cancer is lymphoma is Peripheral T-cell lymphoma (PTCL).

In one aspect, this invention provides a composition comprising a multifunctional molecule or an antibody molecule disclosed herein for use in a method of treating a subject having cancer.

Accordingly, in one aspect, the disclosure features multifunctional molecule, comprising:
(i) a first antigen binding domain that selectively binds to T cell receptor beta chain constant domain 1 (TRBC1) or T cell receptor beta chain constant domain 2 (TRBC2),
and
(ii) one, two, or all of:
(a) an immune cell engager chosen from an NK cell engager (e.g., a molecule that binds to NKp30, NKp46, NKG2D, or CD16), T cell engager (e.g., that binds to a T cell antigen other than CD3), a B cell engager, a dendritic cell engager, or a macrophage cell engager;
(b) a cytokine molecule or cytokine inhibitor molecule;
(c) a death receptor signal engager; and
(d) a stromal modifying moiety.

In another aspect, the disclosure features a multifunctional molecule, comprising:
(i) a first antigen binding domain that selectively targets lymphocytes expressing (e.g., on their surface, e.g., displaying) a T cell receptor comprising T cell receptor beta chain constant domain 1 (TRBC1), TRBC1, a T cell receptor comprising T cell receptor beta chain constant domain 2 (TRBC2), or TRBC2,
and
(ii) one, two, or all of:
(a) an immune cell engager chosen from an NK cell engager (e.g., a molecule that binds to NKp30, NKp46, NKG2D, or CD16), a T cell engager (e.g., that binds to a T cell antigen other than CD3), a B cell engager, a dendritic cell engager, or a macrophage cell engager;
(b) a cytokine molecule or cytokine inhibitor molecule;
(c) a death receptor signal engager; and
(c) a stromal modifying moiety.

In another aspect, the disclosure features a multifunctional molecule, comprising:
(i) a first antigen binding domain that preferentially binds to a tumor antigen on a lymphoma cell (e.g., T cell), e.g., a T cell receptor comprising T cell receptor beta chain constant domain 1 (TRBC1), TRBC1, a T cell receptor comprising T cell receptor beta chain constant domain 2 (TRBC2), or TRBC2,
and
(ii) one, two, or all of:
(a) an immune cell engager chosen from an NK cell engager (e.g., a molecule that binds to NKp30, NKp46, NKG2D, or CD16), a T cell engager (e.g., that binds to a T cell antigen other than CD3), a B cell engager, a dendritic cell engager, or a macrophage cell engager;
(b) a cytokine molecule or cytokine inhibitor molecule;
(c) a death receptor signal engager; and
(d) a stromal modifying moiety.

In another aspect, the disclosure features an antibody molecule, e.g., an IgM antibody molecule, comprising:
(i) a first antigen binding domain that selectively binds to T cell receptor beta chain constant domain 1 (TRBC1) or T cell receptor beta chain constant domain 2 (TRBC2),
and
(ii) a complement activating domain that activates the complement pathway, e.g., by binding C1q.

In another aspect, the disclosure features an antibody molecule comprising:
a heavy chain variable region (VH) comprising a heavy chain framework region 1 (VHFWR1) amino acid sequence of SEQ ID NO: 215 (or a sequence with no more than 1, 2, 3, 4, 5, or 6 mutations, e.g., substitutions, additions, or deletions, therefrom), a VHFWR2 amino acid sequence of SEQ ID NO: 216 (or a sequence with no more than 1, 2, 3, 4, 5, or 6 mutations, e.g., substitutions, additions, or deletions, therefrom), a VHFWR3 amino acid sequence of SEQ ID NO: 217 (or a sequence with no more than 1, 2, 3, 4, 5, or 6 mutations, e.g., substitutions, additions, or deletions, therefrom), and/or a VHFWR4 amino acid sequence of SEQ ID NO: 218 (or a sequence with no more than 1, 2, 3, 4, 5, or 6 mutations, e.g., substitutions, additions, or deletions, therefrom), and
a light chain variable region (VL) comprising a light chain framework region 1 (VLFWR1) amino acid sequence of SEQ ID NO: 238 (or a sequence with no more than 1, 2, 3, 4, 5, or 6 mutations, e.g., substitutions, additions, or deletions, therefrom), a VLFWR2 amino acid sequence of SEQ ID NO: 239 (or a sequence with no more than 1, 2, 3, 4, 5, or 6 mutations, e.g., substitutions, additions, or deletions, therefrom), a VLFWR3 amino acid sequence of SEQ ID NO: 240 (or a sequence with no more than 1, 2, 3, 4, 5, or 6 mutations, e.g., substitutions, additions, or deletions, therefrom), and/or a VLFWR4 amino acid sequence of SEQ ID NO: 241 (or a sequence with no more than 1, 2, 3, 4, 5, or 6 mutations, e.g., substitutions, additions, or deletions, therefrom).

In some embodiments, the antibody molecule or fragment thereof comprises a VH comprising the amino acid sequence of SEQ ID NO: 253 (or an amino acid sequence having at least about 75%, 80%, 85%, 90%, 95%, or 99% sequence identity thereto), and/or a VL comprising the amino acid sequence of SEQ ID NO: 258 (or an amino acid sequence having at least about 93%, 95%, or 99% sequence identity thereto).

In another aspect, the disclosure features a nucleic acid molecule encoding a multifunctional molecule disclosed herein.

In another aspect, the disclosure features a vector, e.g., an expression vector, comprising the nucleic acid molecules disclosed herein.

In another aspect, the disclosure features a host cell comprising a nucleic acid molecule or vector disclosed herein.

In another aspect, the disclosure features a method of making, e.g., producing, a multifunctional molecule disclosed herein, comprising culturing a host cell disclosed herein under suitable conditions, e.g., conditions suitable for gene expression and/or homo- or heterodimerization.

In another aspect, the disclosure features a pharmaceutical composition comprising a multifunctional molecule disclosed herein.

In another aspect, the disclosure features a method of treating a cancer, comprising administering to a subject in need thereof a multifunctional molecule disclosed herein, wherein the multifunctional molecule is administered in an amount effective to treat the cancer. In some embodiments, the cancer is a T cell malignancy, e.g., a T cell lymphoma or a T cell leukemia. In some embodiments, the cancer is chosen from: anaplastic large cell lymphoma (ALCL); angioimmunoblastic T cell lymphoma; peripheral T cell lymphoma (PTCL), not otherwise specified (NOS); cutaneous T-cell lymphoma (CTCL); NKT cell lymphoma; Sezary syndrome; T acute lymphoblastic leukemia or lymphoma; adult T cell leukemia or lymphoma; T prolymphocytic leukemia; and T large granular leukemia. In some embodiments, the cancer is PTCL. In some embodiments, TRBC subtype expression is analyzed by flow cytometry analysis of, e.g., fresh tumor tissue. In some embodiments, the multifunctional molecule is used in combination with a second agent. In some embodiments, the second agent is a histone deacetylases (HDAC) inhibitor, e.g., romidepsin or belinostat. In some embodiments, the second agent is a kinase or enzyme inhibitor. In some embodiments, the second agent is a PI3K inhibitor, e.g., duvelisib. In some embodiments, the second agent is a farnesyltransferase inhibitor, e.g., tipifarnib. In some embodiments, the second agent is a SYK/JAK inhibitor, e.g., cerdulatinib. In some embodiments, the second agent is a chemotherapy.

In some embodiments, the second agent is

In another aspect, the disclosure features a method of identifying a subject in need of treatment for cancer using a multifunctional molecule disclosed herein, comprising determining (e.g., directly determining or indirectly determining, e.g., obtaining information regarding) whether a subject has cancer cells that express a T cell receptor comprising TRBC1 or TRBC2, wherein:

responsive to determining that the subject has cancer cells that express a T cell receptor comprising TRBC1, identifying the subject as a candidate for treatment using a multifunctional molecule comprising an antigen binding domain that binds to TRBC1, and optionally not as a candidate for treatment using a multifunctional molecule comprising an antigen binding domain that binds to TRBC2, and responsive to determining that the subject has cancer cells that express a T cell receptor comprising TRBC2, identifying the subject as a candidate for treatment using a multifunctional molecule comprising an antigen binding domain that binds to TRBC2, and optionally not as a candidate for treatment using a multifunctional molecule comprising an antigen binding domain that binds to TRBC1.

In another aspect, the disclosure features a method of evaluating a subject in need of treatment for cancer, e.g., a lymphoma, comprising determining (e.g., directly determining or indirectly determining, e.g., obtaining information regarding) whether a subject has cancer cells that express a T cell receptor comprising TRBC1 or TRBC2.

Additional features of any of the aforesaid multifunctional molecules, nucleic acids, vectors, host cells, or methods include one or more of the following enumerated embodiments.

Those skilled in the art will recognize, or be able to ascertain using no more than routine experimentation, many equivalents to the specific embodiments of the invention described herein. Such equivalents are intended to be encompassed by the following enumerated embodiments.

Enumerated Embodiments

1. A multifunctional molecule, comprising:
(i) a first antigen binding domain that preferentially binds to a tumor antigen on a lymphoma cell (e.g., T cell), wherein the tumor antigen is T cell receptor beta chain constant domain 1 (TRBC1) or T cell receptor beta chain constant domain 2 (TRBC2),
and
(ii) one, two, or all of:
(a) an immune cell engager chosen from an NK cell engager (e.g., a molecule that binds to NKp30, NKp46, NKG2D, or CD16), a T cell engager, a B cell engager, a dendritic cell engager, or a macrophage cell engager;
(b) a cytokine molecule or cytokine inhibitor molecule;
(c) a death receptor signal engager; and
(d) a stromal modifying moiety.

1A. A multifunctional molecule, comprising:
(i) a first antigen binding domain that selectively binds to T cell receptor beta chain constant domain 1 (TRBC1) or T cell receptor beta chain constant domain 2 (TRBC2),
and
(ii) one, two, or all of:
(a) an immune cell engager chosen from an NK cell engager (e.g., a molecule that binds to NKp30, NKp46, NKG2D, or CD16), a T cell engager that binds to a T cell antigen other than CD3, a B cell engager, a dendritic cell engager, or a macrophage cell engager;
(b) a cytokine molecule or cytokine inhibitor molecule;
(c) a death receptor signal engager; and
(d) a stromal modifying moiety.

2. A multifunctional molecule, comprising:
(i) a first antigen binding domain that selectively targets lymphocytes expressing T cell receptor beta chain constant domain 1 (TRBC1) or T cell receptor beta chain constant domain 2 (TRBC2),
and
(ii) one, two, or all of:
(a) an immune cell engager chosen from an NK cell engager (e.g., a molecule that binds to NKp30, NKp46, NKG2D, or CD16), a T cell engager, a B cell engager, a dendritic cell engager, or a macrophage cell engager;
(b) a cytokine molecule or cytokine inhibitor molecule;
(c) a death receptor signal engager; and
(d) a stromal modifying moiety.

3. The multifunctional molecule of any preceding embodiment, wherein the multifunctional molecule:
(i) binds specifically to an epitope of TRBC1 or TRBC2, e.g., the same or similar epitope as the epitope recognized by an anti-TRBC1 or anti-TRBC2 antibody molecule as described herein;
(ii) shows the same or similar binding affinity or specificity, or both, as an anti-TRBC1 or anti-TRBC2 antibody molecule as described herein;

(iii) inhibits, e.g., competitively inhibits, the binding of an anti-TRBC1 or anti-TRBC2 antibody molecule as described herein;
(iv) binds the same or an overlapping epitope with an anti-TRBC1 or anti-TRBC2 antibody molecule as described herein; or
(v) competes for binding, and/or binds the same epitope, with an anti-TRBC1 or anti-TRBC2 antibody molecule as described herein.

4. The multifunctional molecule of embodiment 3, wherein the anti-TRBC1 or anti-TRBC2 antibody molecule comprises one or more CDRs, framework regions, variable domains, heavy or light chains, or an antigen binding domain chosen from Tables 2-5, or a sequence substantially identical thereto.

5. The multifunctional molecule of any of embodiments 1-4, wherein the antigen or tumor antigen is TRBC1.

6. The multifunctional molecule of any of embodiments 1-4, wherein the antigen or tumor antigen is TRBC2.

7. The multifunctional molecule of any of embodiments 1-5, wherein the first antigen binding domain comprises:
(i) a heavy chain variable region (VH) comprising a heavy chain complementarity determining region 1 (VHCDR1) amino acid sequence of SEQ ID NO: 200 (or a sequence with no more than 1, 2, 3, or 4 mutations, e.g., substitutions, additions, or deletions), a VHCDR2 amino acid sequence of SEQ ID NO: 201 (or a sequence with no more than 1, 2, 3, or 4 mutations, e.g., substitutions, additions, or deletions), and/or a VHCDR3 amino acid sequence of SEQ ID NO: 202 (or a sequence with no more than 1, 2, 3, or 4 mutations, e.g., substitutions, additions, or deletions), and
(ii) a light chain variable region (VL) comprising a light chain complementarity determining region 1 (VLCDR1) amino acid sequence of SEQ ID NO: 223 (or a sequence with no more than 1, 2, 3, or 4 mutations, e.g., substitutions, additions, or deletions), a VLCDR2 amino acid sequence of SEQ ID NO: 224 (or a sequence with no more than 1, 2, 3, or 4 mutations, e.g., substitutions, additions, or deletions), and/or a VLCDR3 amino acid sequence of SEQ ID NO: 225 (or a sequence with no more than 1, 2, 3, or 4 mutations, e.g., substitutions, additions, or deletions).

8. The multifunctional molecule of embodiment 7, wherein the first antigen binding domain comprises:
(i) a heavy chain variable region (VH) comprising a heavy chain complementarity determining region 1 (VHCDR1) amino acid sequence of SEQ ID NO: 200, a VHCDR2 amino acid sequence of SEQ ID NO: 201, and/or a VHCDR3 amino acid sequence of SEQ ID NO: 202, and
(ii) a light chain variable region (VL) comprising a light chain complementarity determining region 1 (VLCDR1) amino acid sequence of SEQ ID NO: 223, a VLCDR2 amino acid sequence of SEQ ID NO: 224, and/or a VLCDR3 amino acid sequence of SEQ ID NO: 225.

9. The multifunctional molecule of any of embodiments 1-5, 7, or 8, wherein the first antigen binding domain comprises:
(1) a heavy chain variable region (VH) comprising a heavy chain framework region 1 (VHFWR1) amino acid sequence of SEQ ID NO: 203 (or a sequence with no more than 1, 2, 3, 4, 5, or 6 mutations, e.g., substitutions, additions, or deletions, therefrom), a VHFWR2 amino acid sequence of SEQ ID NO: 204 (or a sequence with no more than 1, 2, 3, 4, 5, or 6 mutations, e.g., substitutions, additions, or deletions, therefrom), a VHFWR3 amino acid sequence of SEQ ID NO: 205 (or a sequence with no more than 1, 2, 3, 4, 5, or 6 mutations, e.g., substitutions, additions, or deletions, therefrom), or a VHFWR4 amino acid sequence of SEQ ID NO: 206 (or a sequence with no more than 1, 2, 3, 4, 5, or 6 mutations, e.g., substitutions, additions, or deletions, therefrom), and/or
(2) a light chain variable region (VL) comprising a light chain framework region 1 (VLFWR1) amino acid sequence of SEQ ID NO: 226 (or a sequence with no more than 1, 2, 3, 4, 5, or 6 mutations, e.g., substitutions, additions, or deletions, therefrom), a VLFWR2 amino acid sequence of SEQ ID NO: 227 (or a sequence with no more than 1, 2, 3, 4, 5, or 6 mutations, e.g., substitutions, additions, or deletions, therefrom), a VLFWR3 amino acid sequence of SEQ ID NO: 228 (or a sequence with no more than 1, 2, 3, 4, 5, or 6 mutations, e.g., substitutions, additions, or deletions, therefrom), or a VLFWR4 amino acid sequence of SEQ ID NO: 229 (or a sequence with no more than 1, 2, 3, 4, 5, or 6 mutations, e.g., substitutions, additions, or deletions, therefrom).

10. The multifunctional molecule of embodiment 9, wherein the first antigen binding domain comprises:
(1) a heavy chain variable region (VH) comprising a heavy chain framework region 1 (VHFWR1) amino acid sequence of SEQ ID NO: 203, a VHFWR2 amino acid sequence of SEQ ID NO: 204, a VHFWR3 amino acid sequence of SEQ ID NO: 205, or a VHFWR4 amino acid sequence of SEQ ID NO: 206, and/or
(2) a light chain variable region (VL) comprising a light chain framework region 1 (VLFWR1) amino acid sequence of SEQ ID NO: 226, a VLFWR2 amino acid sequence of SEQ ID NO: 227, a VLFWR3 amino acid sequence of SEQ ID NO: 228, or a VLFWR4 amino acid sequence of SEQ ID NO: 229.

11. The multifunctional molecule of any one of embodiments 1-5 or 7-10, wherein the first antigen binding domain comprises:
(i) a VH comprising the amino acid sequence of SEQ ID NO: 250 (or an amino acid sequence having at least about 75%, 80%, 85%, 90%, 95%, or 99% sequence identity to SEQ ID NO: 250), and/or
(ii) a VL comprising the amino acid sequence of SEQ ID NO: 255 (or an amino acid sequence having at least about 93%, 95%, or 99% sequence identity to SEQ ID NO: 255).

12. The multifunctional molecule of any of embodiments 1-5 or 7-11, wherein the first antigen binding domain comprises a heavy chain comprising the amino acid sequence of SEQ ID NOs: 6154, 6155, 6167, or 6168 (or an amino acid sequence having at least about 75%, 80%, 85%, 90%, 95%, or 99% sequence identity to SEQ ID NOs: 6154, 6155, 6167, or 6168).

13. The multifunctional molecule of any of embodiments 1-5 or 7-12, wherein the first antigen binding domain comprises a light chain comprising the amino acid sequence of SEQ ID NOs: 6156 or 6169 (or an amino acid sequence having at least about 75%, 80%, 85%, 90%, 95%, or 99% sequence identity to SEQ ID NOs: 6156 or 6169).

14. The multifunctional molecule of any of embodiments 1-5, 7 or 8, wherein the first antigen binding domain comprises a heavy chain variable region (VH) comprising a heavy chain framework region 1 (VHFWR1) amino acid sequence of SEQ ID NO: 207 (or a sequence with no more than 1, 2, 3, 4, 5, or 6 mutations, e.g., substitutions, additions, or deletions, therefrom), a VHFWR2 amino acid sequence of SEQ ID NO: 208 (or a sequence with no more than 1, 2, 3, 4, 5, or 6 mutations, e.g., substitutions, additions, or deletions, therefrom), a VHFWR3 amino acid sequence of SEQ ID NO: 209 (or a sequence with no more than 1, 2, 3, 4, 5, or 6 mutations, e.g., substitutions, additions, or deletions, therefrom), or a VHFWR4 amino acid sequence of SEQ ID NO: 210 (or a sequence with no more than 1, 2, 3, 4, 5, or 6 mutations, e.g., substitutions, additions, or deletions, therefrom).

The multifunctional molecule of embodiment 14, wherein the first antigen binding domain comprises a heavy chain variable region (VH) comprising a heavy chain framework region 1 (VHFWR1) amino acid sequence of SEQ ID NO: 207, a VHFWR2 amino acid sequence of SEQ ID NO: 208, a VHFWR3 amino acid sequence of SEQ ID NO: 209, or a VHFWR4 amino acid sequence of SEQ ID NO: 210.

16. The multifunctional molecule of any of embodiments 1-5, 7 or 8, wherein the first antigen binding domain comprises a heavy chain variable region (VH) comprising a heavy chain framework region 1 (VHFWR1) amino acid sequence of SEQ ID NO: 211 (or a sequence with no more than 1, 2, 3, 4, 5, or 6 mutations, e.g., substitutions, additions, or deletions, therefrom), a VHFWR2 amino acid sequence of SEQ ID NO: 212 (or a sequence with no more than 1, 2, 3, 4, 5, or 6 mutations, e.g., substitutions, additions, or deletions, therefrom), a VHFWR3 amino acid sequence of SEQ ID NO: 213 (or a sequence with no more than 1, 2, 3, 4, 5, or 6 mutations, e.g., substitutions, additions, or deletions, therefrom), or a VHFWR4 amino acid sequence of SEQ ID NO: 214 (or a sequence with no more than 1, 2, 3, 4, 5, or 6 mutations, e.g., substitutions, additions, or deletions, therefrom).

17. The multifunctional molecule of embodiment 16, wherein the first antigen binding domain comprises a heavy chain variable region (VH) comprising a heavy chain framework region 1 (VHFWR1) amino acid sequence of SEQ ID NO: 211, a VHFWR2 amino acid sequence of SEQ ID NO: 212, a VHFWR3 amino acid sequence of SEQ ID NO: 213, or a VHFWR4 amino acid sequence of SEQ ID NO: 214.

18. The multifunctional molecule of any of embodiments 1-5, 7, or 8, wherein the first antigen binding domain comprises a heavy chain variable region (VH) comprising a heavy chain framework region 1 (VHFWR1) amino acid sequence of SEQ ID NO: 215 (or a sequence with no more than 1, 2, 3, 4, 5, or 6 mutations, e.g., substitutions, additions, or deletions, therefrom), a VHFWR2 amino acid sequence of SEQ ID NO: 216 (or a sequence with no more than 1, 2, 3, 4, 5, or 6 mutations, e.g., substitutions, additions, or deletions, therefrom), a VHFWR3 amino acid sequence of SEQ ID NO: 217 (or a sequence with no more than 1, 2, 3, 4, 5, or 6 mutations, e.g., substitutions, additions, or deletions, therefrom), or a VHFWR4 amino acid sequence of SEQ ID NO: 218 (or a sequence with no more than 1, 2, 3, 4, 5, or 6 mutations, e.g., substitutions, additions, or deletions, therefrom).

19. The multifunctional molecule of embodiment 18, wherein the first antigen binding domain comprises a heavy chain variable region (VH) comprising a heavy chain framework region 1 (VHFWR1) amino acid sequence of SEQ ID NO: 215, a VHFWR2 amino acid sequence of SEQ ID NO: 216, a VHFWR3 amino acid sequence of SEQ ID NO: 217, or a VHFWR4 amino acid sequence of SEQ ID NO: 218.

20. The multifunctional molecule of any of embodiments 1-5, 7, or 8, wherein the first antigen binding domain comprises a heavy chain variable region (VH) comprising a heavy chain framework region 1 (VHFWR1) amino acid sequence of SEQ ID NO: 219 (or a sequence with no more than 1, 2, 3, 4, 5, or 6 mutations, e.g., substitutions, additions, or deletions, therefrom), a VHFWR2 amino acid sequence of SEQ ID NO: 220 (or a sequence with no more than 1, 2, 3, 4, 5, or 6 mutations, e.g., substitutions, additions, or deletions, therefrom), a VHFWR3 amino acid sequence of SEQ ID NO: 221 (or a sequence with no more than 1, 2, 3, 4, 5, or 6 mutations, e.g., substitutions, additions, or deletions, therefrom), or a VHFWR4 amino acid sequence of SEQ ID NO: 222 (or a sequence with no more than 1, 2, 3, 4, 5, or 6 mutations, e.g., substitutions, additions, or deletions, therefrom).

21. The multifunctional molecule of embodiment 20, wherein the first antigen binding domain comprises a heavy chain variable region (VH) comprising a heavy chain framework region 1 (VHFWR1) amino acid sequence of SEQ ID NO: 219, a VHFWR2 amino acid sequence of SEQ ID NO: 220, a VHFWR3 amino acid sequence of SEQ ID NO: 221, or a VHFWR4 amino acid sequence of SEQ ID NO: 222.

22. The multifunctional molecule of any of embodiments 1-5, 7, 8, or 14-21, wherein the first antigen binding domain comprises a light chain variable region (VL) comprising a light chain framework region 1 (VLFWR1) amino acid sequence of SEQ ID NO: 230 (or a sequence with no more than 1, 2, 3, 4, 5, or 6 mutations, e.g., substitutions, additions, or deletions, therefrom), a VLFWR2 amino acid sequence of SEQ ID NO: 231 (or a sequence with no more than 1, 2, 3, 4, 5, or 6 mutations, e.g., substitutions, additions, or deletions, therefrom), a VLFWR3 amino acid sequence of SEQ ID NO: 232 (or a sequence with no more than 1, 2, 3, 4, 5, or 6 mutations, e.g., substitutions, additions, or deletions, therefrom), or a VLFWR4 amino acid sequence of SEQ ID NO: 233 (or a sequence with no more than 1, 2, 3, 4, 5, or 6 mutations, e.g., substitutions, additions, or deletions, therefrom).

23. The multifunctional molecule of embodiment 22, wherein the first antigen binding domain comprises a light chain variable region (VL) comprising a light chain framework region 1 (VLFWR1) amino acid sequence of SEQ ID NO: 230, a VLFWR2 amino acid sequence of SEQ ID NO: 231, a VLFWR3 amino acid sequence of SEQ ID NO: 232, or a VLFWR4 amino acid sequence of SEQ ID NO: 233.

24. The multifunctional molecule of any of embodiments 1-5, 7, 8, or 14-21, wherein the first antigen binding domain comprises a light chain variable region (VL) comprising a light chain framework region 1 (VLFWR1) amino acid sequence of SEQ ID NO: 234 (or a sequence with no more than 1, 2, 3, 4, 5, or 6 mutations, e.g., substitutions, additions, or deletions, therefrom), a VLFWR2 amino acid sequence of SEQ ID NO: 235 (or a sequence with no more than 1, 2, 3, 4, 5, or 6 mutations, e.g., substitutions, additions, or deletions, therefrom), a VLFWR3 amino acid sequence of SEQ ID NO: 236 (or a sequence with no more than 1, 2, 3, 4, 5, or 6 mutations, e.g., substitutions, additions, or deletions, therefrom), or a VLFWR4 amino acid sequence of SEQ ID NO: 237 (or a sequence with no more than 1, 2, 3, 4, 5, or 6 mutations, e.g., substitutions, additions, or deletions, therefrom).

25. The multifunctional molecule of embodiment 24, wherein the first antigen binding domain comprises a light chain variable region (VL) comprising a light chain framework region 1 (VLFWR1) amino acid sequence of SEQ ID NO: 234, a VLFWR2 amino acid sequence of SEQ ID NO: 235, a VLFWR3 amino acid sequence of SEQ ID NO: 236, or a VLFWR4 amino acid sequence of SEQ ID NO: 237.

26. The multifunctional molecule of any of embodiments 1-5, 7, 8, or 14-21, wherein the first antigen binding domain comprises a light chain variable region (VL) comprising a light chain framework region 1 (VLFWR1) amino acid sequence of SEQ ID NO: 238 (or a sequence with no more than 1, 2, 3, 4, 5, or 6 mutations, e.g., substitutions, additions, or deletions, therefrom), a VLFWR2 amino acid sequence of SEQ ID NO: 239 (or a sequence with no more than 1, 2, 3, 4, 5, or 6 mutations, e.g., substitutions, additions, or deletions, therefrom), a VLFWR3 amino acid sequence of SEQ ID NO: 240 (or a sequence with no more than 1, 2, 3, 4, 5, or 6 mutations, e.g., substitutions, additions, or deletions, therefrom), or a VLFWR4 amino acid sequence of SEQ ID NO: 241 (or a sequence with no more than 1, 2, 3, 4, 5, or 6 mutations, e.g., substitutions, additions, or deletions, therefrom).

27. The multifunctional molecule of embodiment 26, wherein the first antigen binding domain comprises a light chain variable region (VL) comprising a light chain framework region 1 (VLFWR1) amino acid sequence of SEQ ID NO: 238, a VLFWR2 amino acid sequence of SEQ ID NO: 239, a VLFWR3 amino acid sequence of SEQ ID NO: 240, or a VLFWR4 amino acid sequence of SEQ ID NO: 241.

28. The multifunctional molecule of any of embodiments 1-5, 7, 8, or 14-21, wherein the first antigen binding domain comprises a light chain variable region (VL) comprising a light chain framework region 1 (VLFWR1) amino acid sequence of SEQ ID NO: 242 (or a sequence with no more than 1, 2, 3, 4, 5, or 6 mutations, e.g., substitutions, additions, or deletions, therefrom), a VLFWR2 amino acid sequence of SEQ ID NO: 243 (or a sequence with no more than 1, 2, 3, 4, 5, or 6 mutations, e.g., substitutions, additions, or deletions, therefrom), a VLFWR3 amino acid sequence of SEQ ID NO: 244 (or a sequence with no more than 1, 2, 3, 4, 5, or 6 mutations, e.g., substitutions, additions, or deletions, therefrom), or a VLFWR4 amino acid sequence of SEQ ID NO: 245 (or a sequence with no more than 1, 2, 3, 4, 5, or 6 mutations, e.g., substitutions, additions, or deletions, therefrom).

29. The multifunctional molecule of embodiment 28, wherein the first antigen binding domain comprises a light chain variable region (VL) comprising a light chain framework region 1 (VLFWR1) amino acid sequence of SEQ ID NO: 242, a VLFWR2 amino acid sequence of SEQ ID NO: 243, a VLFWR3 amino acid sequence of SEQ ID NO: 244, or a VLFWR4 amino acid sequence of SEQ ID NO: 245.

30. The multifunctional molecule of any of embodiments 1-5, 7, 8, or 14-21, wherein the first antigen binding domain comprises a light chain variable region (VL) comprising a light chain framework region 1 (VLFWR1) amino acid sequence of SEQ ID NO: 246 (or a sequence with no more than 1, 2, 3, 4, 5, or 6 mutations, e.g., substitutions, additions, or deletions, therefrom), a VLFWR2 amino acid sequence of SEQ ID NO: 247 (or a sequence with no more than 1, 2, 3, 4, 5, or 6 mutations, e.g., substitutions, additions, or deletions, therefrom), a VLFWR3 amino acid sequence of SEQ ID NO: 248 (or a sequence with no more than 1, 2, 3, 4, 5, or 6 mutations, e.g., substitutions, additions, or deletions, therefrom), or a VLFWR4 amino acid sequence of SEQ ID NO: 249 (or a sequence with no more than 1, 2, 3, 4, 5, or 6 mutations, e.g., substitutions, additions, or deletions, therefrom).

31. The multifunctional molecule of embodiment 30, wherein the first antigen binding domain comprises a light chain variable region (VL) comprising a light chain framework region 1 (VLFWR1) amino acid sequence of SEQ ID NO: 246, a VLFWR2 amino acid sequence of SEQ ID NO: 247, a VLFWR3 amino acid sequence of SEQ ID NO: 248, or a VLFWR4 amino acid sequence of SEQ ID NO: 249.

32. The multifunctional molecule of any one of embodiments 1-5, 7, or 8 wherein the first antigen binding domain comprises a VH comprising the amino acid sequence of SEQ ID NO: 251 (or an amino acid sequence having at least about 75%, 80%, 85%, 90%, 95%, or 99% sequence identity thereto).

33. The multifunctional molecule of any one of embodiments 1-5, 7, or 8, wherein the first antigen binding domain comprises a VH comprising the amino acid sequence of SEQ ID NO: 252 (or an amino acid sequence having at least about 75%, 80%, 85%, 90%, 95%, or 99% sequence identity thereto).

34. The multifunctional molecule of any one of embodiments 1-5, 7, or 8, wherein the first antigen binding domain comprises a VH comprising the amino acid sequence of SEQ ID NO: 253 (or an amino acid sequence having at least about 75%, 80%, 85%, 90%, 95%, or 99% sequence identity thereto).

35. The multifunctional molecule of any one of embodiments 1-5, 7, or 8, wherein the first antigen binding domain comprises a VH comprising the amino acid sequence of SEQ ID NO: 254 (or an amino acid sequence having at least about 75%, 80%, 85%, 90%, 95%, or 99% sequence identity thereto).

36. The multifunctional molecule of any one of embodiments 1-5, 7, 8, or 32-35, wherein the first antigen binding domain comprises a VL comprising the amino acid sequence of SEQ ID NO: 256 (or an amino acid sequence having at least about 93%, 95%, or 99% sequence identity thereto).

37. The multifunctional molecule of any one of embodiments 1-5, 7, 8, or 32-35, wherein the first antigen binding domain comprises a VL comprising the amino acid sequence of SEQ ID NO: 257 (or an amino acid sequence having at least about 93%, 95%, or 99% sequence identity thereto).

38. The multifunctional molecule of any one of embodiments 1-5, 7, 8, or 32-35, wherein the first antigen binding domain comprises a VL comprising the amino acid sequence of SEQ ID NO: 258 (or an amino acid sequence having at least about 93%, 95%, or 99% sequence identity thereto).

39. The multifunctional molecule of any one of embodiments 1-5, 7, 8, or 32-35, wherein the first antigen binding domain comprises a VL comprising the amino acid sequence of SEQ ID NO: 259 (or an amino acid sequence having at least about 93%, 95%, or 99% sequence identity thereto).

40 The multifunctional molecule of any one of embodiments 1-5, 7, 8, or 32-35, wherein the first antigen binding domain comprises a VL comprising the amino acid sequence of SEQ ID NO: 260 (or an amino acid sequence having at least about 93%, 95%, or 99% sequence identity thereto).

41. The multifunctional molecule of any of embodiments 1-5, 7, or 8, wherein the first antigen binding domain comprises:
  (i) a heavy chain variable region (VH) comprising a heavy chain framework region 1 (VHFWR1) amino acid sequence of SEQ ID NO: 215 (or a sequence with no more than 1, 2, 3, 4, 5, or 6 mutations, e.g., substitutions, additions, or deletions, therefrom), a VHFWR2 amino acid sequence of SEQ ID NO: 216 (or a sequence with no more than 1, 2, 3, 4, 5, or 6 mutations, e.g., substitutions, additions, or deletions, therefrom), a VHFWR3 amino acid sequence of SEQ ID NO: 217 (or a sequence with no more than 1, 2, 3, 4, 5, or 6 mutations, e.g., substitutions, additions, or deletions, therefrom), or a VHFWR4 amino acid sequence of SEQ ID NO: 218 (or a sequence with no more than 1, 2, 3, 4, 5, or 6 mutations, e.g., substitutions, additions, or deletions, therefrom), and (ii) a light chain variable region (VL) comprising a light chain framework region 1 (VLFWR1) amino acid sequence of SEQ ID NO: 238 (or a sequence with no more than 1, 2, 3, 4, 5, or 6 mutations, e.g., substitutions, additions, or deletions, therefrom), a VLFWR2 amino acid sequence of SEQ ID NO: 239 (or a sequence with no more than 1, 2, 3, 4, 5, or 6 mutations, e.g., substitutions, additions, or deletions, therefrom), a VLFWR3 amino acid sequence of SEQ ID NO: 240 (or a sequence with no more than 1, 2, 3, 4, 5, or 6 mutations, e.g., substitutions, additions, or deletions, therefrom), or a VLFWR4 amino acid sequence of SEQ ID NO: 241 (or a sequence with no more than 1, 2, 3, 4, 5, or 6 mutations, e.g., substitutions, additions, or deletions, therefrom).

42. The multifunctional molecule of embodiment 41, wherein the first antigen binding domain comprises:
   (i) a heavy chain variable region (VH) comprising a heavy chain framework region 1 (VHFWR1) amino acid sequence of SEQ ID NO: 215, a VHFWR2 amino acid sequence of SEQ ID NO: 216, a VHFWR3 amino acid sequence of SEQ ID NO: 217, or a VHFWR4 amino acid sequence of SEQ ID NO: 218, and
   (ii) a light chain variable region (VL) comprising a light chain framework region 1 (VLFWR1) amino acid sequence of SEQ ID NO: 238, a VLFWR2 amino acid sequence of SEQ ID NO: 239, a VLFWR3 amino acid sequence of SEQ ID NO: 240, or a VLFWR4 amino acid sequence of SEQ ID NO: 241.

43. The multifunctional molecule of either of embodiments 41 or 42, wherein the first antigen binding domain comprises:
   (i) a VH comprising the amino acid sequence of SEQ ID NO: 253 (or an amino acid sequence having at least about 75%, 80%, 85%, 90%, 95%, or 99% sequence identity thereto), and
   (ii) a VL comprising the amino acid sequence of SEQ ID NO: 258 (or an amino acid sequence having at least about 93%, 95%, or 99% sequence identity thereto).

44. The multifunctional molecule of any one of embodiments 1-43, wherein the first antigen binding domain has a higher affinity for a T cell receptor comprising TRBC1 than for T cell receptors not comprising TRBC1, optionally wherein the $K_D$ for the binding between the first antigen binding domain and TRBC1 is no more than 40%, 30%, 20%, 10%, 1%, 0.1%, or 0.01% of the $K_D$ for the binding between the first antigen binding domain and a T cell receptor not comprising TRBC1.

45. The multifunctional molecule of any one of embodiments 1-4 or 6, wherein the first antigen binding domain has a higher affinity for a T cell receptor comprising TRBC2 than for T cell receptors not comprising TRBC2, optionally wherein the $K_D$ for the binding between the first antigen binding domain and TRBC2 is no more than 40%, 30%, 20%, 10%, 1%, 0.1%, or 0.01% of the $K_D$ for the binding between the first antigen binding domain and a T cell receptor not comprising TRBC2.

46. The multifunctional molecule of any one of embodiments 1-44, wherein the first antigen binding domain has a higher affinity for a T cell receptor comprising TRBC1 than for T cell receptors comprising TRBC2, optionally wherein the $K_D$ for the binding between the first antigen binding domain and TRBC1 is no more than 40%, 30%, 20%, 10%, 1%, 0.1%, or 0.01% of the $K_D$ for the binding between the first antigen binding domain and a T cell receptor comprising TRBC2.

47. The multifunctional molecule of any one of embodiments 1-4, 6, or 45, wherein the first antigen binding domain has a higher affinity for a T cell receptor comprising TRBC2 than for T cell receptors comprising TRBC1, optionally wherein the $K_D$ for the binding between the first antigen binding domain and TRBC2 is no more than 40%, 30%, 20%, 10%, 1%, 0.1%, or 0.01% of the $K_D$ for the binding between the first antigen binding domain and a T cell receptor comprising TRBC1.

48. The multifunctional molecule of any preceding embodiment, wherein binding of the first antigen binding domain to TRBC1 or TRBC2 on a lymphoma cell or lymphocyte (e.g., T cell) or the tumor antigen on the lymphoma cell (e.g., T cell) does not activate the lymphoma cell or lymphocyte, e.g., T cell.

49. The multifunctional molecule of any preceding embodiment, wherein binding of the first antigen binding domain to TRBC1 or TRBC2 on a lymphoma cell or lymphocyte (e.g., T cell) or the tumor antigen on the lymphoma cell e.g., T cell) does not appreciably activate the lymphoma cell or lymphocyte, e.g., T cell, (e.g., as measured by T cell proliferation, expression of a T cell activation marker (e.g., CD69 or CD25), and/or expression of a cytokine (e.g., TNFα and IFNγ).

50. The multifunctional molecule of any one of embodiments 1 or 3-49, wherein the multifunctional molecule preferentially binds to a lymphoma cell over a non-lymphoma cell, optionally wherein the binding between the multifunctional molecule and the lymphoma cell is more than 10, 20, 30, 40, or 50-fold greater than the binding between the multifunctional molecule and a non-lymphoma cell.

51. The multifunctional molecule of any one of embodiments 2-47, wherein:
   (i) the binding between the multifunctional molecule and the lymphocyte expressing TRBC1 is more than 10, 20, 30, 40, or 50-fold greater than the binding between the multifunctional molecule and a lymphocyte that does not express TRBC1, or
   (ii) the binding between the multifunctional molecule and the lymphocyte expressing TRBC2 is more than 10, 20, 30, 40, or 50-fold greater than the binding between the multifunctional molecule and a lymphocyte that does not express TRBC2.

52. The multifunctional molecule of any one of embodiments 1-51, wherein the multifunctional molecule comprises an immune cell engager chosen from an NK cell engager, a T cell engager, a B cell engager, a dendritic cell engager, or a macrophage cell engager.

53. The multifunctional molecule of embodiment 52, wherein the immune cell engager binds to and activates an immune cell, e.g., an effector cell.

54. The multifunctional molecule of embodiment 52, wherein the immune cell engager binds to, but does not activate, an immune cell, e.g., an effector cell.

55. The multifunctional molecule of any one of embodiments 52-54, wherein the immune cell engager is a T cell engager, e.g., a T cell engager that mediates binding to and activation of a T cell, or a T cell engager that mediates binding to but not activation of a T cell.

56. The multifunctional molecule of embodiment 55, wherein the T cell engager binds to TCRα, TCRβ, TCRγ, TCRζ, ICOS, CD28, CD27, HVEM, LIGHT, CD40, 4-1BB, OX40, DR3, GITR, CD30, TIM1, SLAM, CD2, or CD226, e.g., the T cell engager is an anti-TCRβ antibody molecule.

57. The multifunctional molecule of any one of embodiments 52-54, wherein the immune cell engager is an NK cell engager, e.g., an NK cell engager that mediates binding to and activation of an NK cell, or an NK cell engager that mediates binding to but not activation of an NK cell.

58. The multifunctional molecule of embodiment 57, wherein the NK cell engager is chosen from an antibody molecule, e.g., an antigen binding domain, or ligand that binds to (e.g., activates): NKp30, NKp40, NKp44, NKp46, NKG2D, DNAM1, DAP10, CD16 (e.g., CD16a, CD16b, or both), CRTAM, CD27, PSGL1, CD96, CD100 (SEMA4D), NKp80, CD244 (also known as SLAMF4 or 2B4), SLAMF6, SLAMF7, KIR2DS2, KIR2DS4, KIR3DS1, KIR2DS3, KIR2DS5, KIR2DS1, CD94, NKG2C, NKG2E, or CD160, e.g., the NK cell engager is an antibody molecule or ligand that binds to (e.g., activates) NKp30.

59. The multifunctional molecule of embodiment 57, wherein the NK cell engager is an antibody molecule, e.g., an antigen binding domain.

60. The multifunctional molecule of either of embodiments 58 or 59, wherein the NK cell engager is capable of engaging an NK cell.

61. The multifunctional molecule of any one of embodiments 57-60, wherein the NK cell engager is an antibody molecule, e.g., an antigen binding domain, that binds to NKp30, NKp46, NKG2D, or CD16.

62. The multifunctional molecule of any preceding embodiment, wherein the multifunctional molecule:
(i) binds specifically to an epitope of NKp30, NKp46, NKG2D, or CD16, e.g., the same or similar epitope as the epitope recognized by an anti-NKp30, anti-NKp46, anti-NKG2D, or anti-CD16 antibody molecule as described herein;
(ii) shows the same or similar binding affinity or specificity, or both, as an anti-NKp30, anti-NKp46, anti-NKG2D, or anti-CD16 antibody molecule as described herein;
(iii) inhibits, e.g., competitively inhibits, the binding of an anti-NKp30, anti-NKp46, anti-NKG2D, or anti-CD16 antibody molecule as described herein;
(iv) binds the same or an overlapping epitope with an anti-NKp30, anti-NKp46, anti-NKG2D, or anti-CD16 antibody molecule as described herein; or
(v) competes for binding, and/or binds the same epitope, with an anti-NKp30, anti-NKp46, anti-NKG2D, or anti-CD16 molecule as described herein.

63. The multifunctional molecule of any of embodiments 57-62, wherein the anti-NKp30, anti-NKp46, anti-NKG2D, or anti-CD16 antibody molecule comprises one or more CDRs, framework regions, variable domains, heavy or light chains, or an antigen binding domain chosen from Tables 7-10 or 15, or a sequence substantially identical thereto.

64. The multifunctional molecule of any of embodiments 57-63, wherein the NK cell engager is an antibody molecule, e.g., an antigen binding domain, that binds to NKp30.

65. The multifunctional molecule of any of embodiments 57-64, wherein lysis of the lymphoma cell or lymphocyte is mediated by NKp30.

66. The multifunctional molecule of any of embodiments 57-65, wherein the multifunctional molecule does not activate the NK cell when incubated with the NK cell in the absence of the tumor antigen on the lymphoma cell or TRBC1 or TRBC2 on the lymphocyte.

67. The multifunctional molecule of any of embodiments 57-66, wherein the multifunctional molecule activates the NK cell when the NK cell is a NKp30 expressing NK cell and either: (1) the tumor antigen on the lymphoma cell is also present or (2) TRBC1 or TRBC2 on the lymphocyte is also present.

68. The multifunctional molecule of any of embodiments 57-67, wherein the multifunctional molecule does not activate the NK cell when the NK cell is not a NKp30 expressing NK cell and either: (1) the tumor antigen on the lymphoma cell is also present or (2) TRBC1 or TRBC2 on the lymphocyte is also present.

69. The multifunctional molecule of any of embodiments 57-68, wherein the NK cell engager comprises:
(i) a heavy chain variable region (VH) comprising a heavy chain complementarity determining region 1 (VHCDR1) amino acid sequence of SEQ ID NO: 6000 (or a sequence with no more than 1, 2, 3, or 4 mutations, e.g., substitutions, additions, or deletions), a VHCDR2 amino acid sequence of SEQ ID NO: 6001 (or a sequence with no more than 1, 2, 3, or 4 mutations, e.g., substitutions, additions, or deletions), and/or a VHCDR3 amino acid sequence of SEQ ID NO: 6002 (or a sequence with no more than 1, 2, 3, or 4 mutations, e.g., substitutions, additions, or deletions), and
(ii) a light chain variable region (VL) comprising a light chain complementarity determining region 1 (VLCDR1) amino acid sequence of SEQ ID NO: 6063 (or a sequence with no more than 1, 2, 3, or 4 mutations, e.g., substitutions, additions, or deletions), a VLCDR2 amino acid sequence of SEQ ID NO: 6064 (or a sequence with no more than 1, 2, 3, or 4 mutations, e.g., substitutions, additions, or deletions), and/or a VLCDR3 amino acid sequence of SEQ ID NO: 7293 (or a sequence with no more than 1, 2, 3, or 4 mutations, e.g., substitutions, additions, or deletions).

70. The multifunctional molecule of embodiment 69, wherein the NK cell engager comprises:
(i) a heavy chain variable region (VH) comprising a heavy chain complementarity determining region 1 (VHCDR1) amino acid sequence of SEQ ID NO: 6000, a VHCDR2 amino acid sequence of SEQ ID NO: 6001, and/or a VHCDR3 amino acid sequence of SEQ ID NO: 6002, and
(ii) a light chain variable region (VL) comprising a light chain complementarity determining region 1 (VLCDR1) amino acid sequence of SEQ ID NO: 6063, a VLCDR2 amino acid sequence of SEQ ID NO: 6064, and/or a VLCDR3 amino acid sequence of SEQ ID NO: 7293.

71. The multifunctional molecule of any of embodiments 57-70, wherein the NK cell engager comprises:
(1) a heavy chain variable region (VH) comprising a heavy chain framework region 1 (VHFWR1) amino acid sequence of SEQ ID NO: 6003 (or a sequence with no more than 1, 2, 3, 4, 5, or 6 mutations, e.g., substitutions, additions, or deletions, therefrom), a VHFWR2 amino acid sequence of SEQ ID NO: 6004 (or a sequence with no more than 1, 2, 3, 4, 5, or 6 mutations, e.g., substitutions, additions, or deletions, therefrom), a VHFWR3 amino acid sequence of SEQ ID NO: 6005 (or a sequence with no more than 1, 2, 3, 4, 5, or 6 mutations, e.g., substitutions, additions, or deletions, therefrom), or a VHFWR4 amino acid sequence of SEQ ID NO: 6006 (or a sequence with no more than 1, 2, 3, 4, 5, or 6 mutations, e.g., substitutions, additions, or deletions, therefrom), and/or
(2) a light chain variable region (VL) comprising a light chain framework region 1 (VLFWR1) amino acid sequence of SEQ ID NO: 6066 (or a sequence with no more than 1, 2, 3, 4, 5, or 6 mutations, e.g., substitutions, additions, or deletions, therefrom), a VLFWR2 amino acid sequence of SEQ ID NO: 6067 (or a sequence with no more than 1, 2, 3, 4, 5, or 6 mutations, e.g., substitutions, additions, or deletions, therefrom), a VLFWR3 amino acid sequence of SEQ ID NO: 7292 (or a sequence with no more than 1, 2, 3, 4, 5, or 6 mutations, e.g., substitutions, additions, or deletions, therefrom), or a VLFWR4 amino acid sequence of SEQ ID NO: 6069 (or a sequence with no more than 1, 2, 3, 4, 5, or 6 mutations, e.g., substitutions, additions, or deletions, therefrom).

72. The multifunctional molecule of embodiment 71, wherein the NK cell engager comprises:
(1) a heavy chain variable region (VH) comprising a heavy chain framework region 1 (VHFWR1) amino acid sequence of SEQ ID NO: 6003, a VHFWR2 amino acid sequence of SEQ ID NO: 6004, a VHFWR3 amino acid sequence of SEQ ID NO: 6005, or a VHFWR4 amino acid sequence of SEQ ID NO: 6006, and
(3) a light chain variable region (VL) comprising a light chain framework region 1 (VLFWR1) amino acid sequence of SEQ ID NO: 6066, a VLFWR2 amino acid sequence of SEQ ID NO: 6067, a VLFWR3 amino acid sequence of SEQ ID NO: 7292, or a VLFWR4 amino acid sequence of SEQ ID NO: 6069.

73. The multifunctional molecule of any one of embodiments 57-72, wherein the NK cell engager comprises:
(i) a VH comprising the amino acid sequence of SEQ ID NO: 6121 (or an amino acid sequence having at least about 75%, 80%, 85%, 90%, 95%, or 99% sequence identity to SEQ ID NO: 6121), and/or
(ii) a VL comprising the amino acid sequence of SEQ ID NO: 7294 (or an amino acid sequence having at least about 93%, 95%, or 99% sequence identity to SEQ ID NO: 7294).

74. The multifunctional molecule of either of embodiments 57-73, wherein the NK cell engager comprises a heavy chain comprising the amino acid sequence of SEQ ID NOs: 6148 or 6149 (or an amino acid sequence having at least about 75%, 80%, 85%, 90%, 95%, or 99% sequence identity to SEQ ID NOs: 6148 or 6149).

75. The multifunctional molecule of either of embodiments 57-74, wherein the NK cell engager comprises a light chain comprising the amino acid sequence of SEQ ID NO: 6150 (or an amino acid sequence having at least about 75%, 80%, 85%, 90%, 95%, or 99% sequence identity to SEQ ID NO: 6150).

76. The multifunctional molecule of either of embodiments 57-75, wherein the NK cell engager comprises a heavy chain comprising the amino acid sequence of SEQ ID NOs: 6148 or 6149 (or an amino acid sequence having at least about 75%, 80%, 85%, 90%, 95%, or 99% sequence identity to SEQ ID NOs: 6148 or 6149), and a light chain comprising the amino acid sequence of SEQ ID NO: 6150 (or an amino acid sequence having at least about 75%, 80%, 85%, 90%, 95%, or 99% sequence identity to SEQ ID NO: 6150).

77. The multifunctional molecule of any of embodiments 57-70, wherein the NK cell engager comprises a heavy chain variable region (VH) comprising a heavy chain framework region 1 (VHFWR1) amino acid sequence of SEQ ID NO: 6014 (or a sequence with no more than 1, 2, 3, 4, 5, or 6 mutations, e.g., substitutions, additions, or deletions, therefrom), a VHFWR2 amino acid sequence of SEQ ID NO: 6015 (or a sequence with no more than 1, 2, 3, 4, 5, or 6 mutations, e.g., substitutions, additions, or deletions, therefrom), a VHFWR3 amino acid sequence of SEQ ID NO: 6016 (or a sequence with no more than 1, 2, 3, 4, 5, or 6 mutations, e.g., substitutions, additions, or deletions, therefrom), or a VHFWR4 amino acid sequence of SEQ ID NO: 6017 (or a sequence with no more than 1, 2, 3, 4, 5, or 6 mutations, e.g., substitutions, additions, or deletions, therefrom).

78. The multifunctional molecule of embodiment 77, wherein the NK cell engager comprises a heavy chain variable region (VH) comprising a heavy chain framework region 1 (VHFWR1) amino acid sequence of SEQ ID NO: 6014, a VHFWR2 amino acid sequence of SEQ ID NO: 6015, a VHFWR3 amino acid sequence of SEQ ID NO: 6016, or a VHFWR4 amino acid sequence of SEQ ID NO: 6017.

79. The multifunctional molecule of embodiment 78, wherein the NK cell engager comprises a VH comprising the amino acid sequence of SEQ ID NO: 6123 (or an amino acid sequence having at least about 75%, 80%, 85%, 90%, 95%, or 99% sequence identity to SEQ ID NO: 6123).

80. The multifunctional molecule of any of embodiments 57-70, wherein the NK cell engager comprises a heavy chain variable region (VH) comprising a heavy chain framework region 1 (VHFWR1) amino acid sequence of SEQ ID NO: 6018 (or a sequence with no more than 1, 2, 3, 4, 5, or 6 mutations, e.g., substitutions, additions, or deletions, therefrom), a VHFWR2 amino acid sequence of SEQ ID NO: 6019 (or a sequence with no more than 1, 2, 3, 4, 5, or 6 mutations, e.g., substitutions, additions, or deletions, therefrom), a VHFWR3 amino acid sequence of SEQ ID NO: 6020 (or a sequence with no more than 1, 2, 3, 4, 5, or 6 mutations, e.g., substitutions, additions, or deletions, therefrom), or a VHFWR4 amino acid sequence of SEQ ID NO: 6021 (or a sequence with no more than 1, 2, 3, 4, 5, or 6 mutations, e.g., substitutions, additions, or deletions, therefrom).

81. The multifunctional molecule of embodiment 80, wherein the NK cell engager comprises a heavy chain variable region (VH) comprising a heavy chain framework region 1 (VHFWR1) amino acid sequence of SEQ ID NO: 6018, a VHFWR2 amino acid sequence of SEQ ID NO: 6019, a VHFWR3 amino acid sequence of SEQ ID NO: 6020, or a VHFWR4 amino acid sequence of SEQ ID NO: 6021.

82. The multifunctional molecule of embodiment 81, wherein the NK cell engager comprises a VH comprising the amino acid sequence of SEQ ID NO: 6124 (or an amino acid sequence having at least about 75%, 80%, 85%, 90%, 95%, or 99% sequence identity to SEQ ID NO: 6124).

83. The multifunctional molecule of any of embodiments 57-70, wherein the NK cell engager comprises a heavy chain variable region (VH) comprising a heavy chain framework region 1 (VHFWR1) amino acid sequence of SEQ ID NO: 6022 (or a sequence with no more than 1, 2, 3, 4, 5, or 6 mutations, e.g., substitutions, additions, or deletions, therefrom), a VHFWR2 amino acid sequence of SEQ ID NO: 6023 (or a sequence with no more than 1, 2, 3, 4, 5, or 6 mutations, e.g., substitutions, additions, or deletions, therefrom), a VHFWR3 amino acid sequence of SEQ ID NO: 6024 (or a sequence with no more than 1, 2, 3, 4, 5, or 6 mutations, e.g., substitutions, additions, or deletions, therefrom), or a VHFWR4 amino acid sequence of SEQ ID NO: 6025 (or a sequence with no more than 1, 2, 3, 4, 5, or 6 mutations, e.g., substitutions, additions, or deletions, therefrom).

84. The multifunctional molecule of embodiment 83, wherein the NK cell engager comprises a heavy chain variable region (VH) comprising a heavy chain framework region 1 (VHFWR1) amino acid sequence of SEQ ID NO: 6022, a VHFWR2 amino acid sequence of SEQ ID NO:

6023, a VHFWR3 amino acid sequence of SEQ ID NO: 6024, or a VHFWR4 amino acid sequence of SEQ ID NO: 6025.

85. The multifunctional molecule of embodiment 84, wherein the NK cell engager comprises a VH comprising the amino acid sequence of SEQ ID NO: 6125 (or an amino acid sequence having at least about 75%, 80%, 85%, 90%, 95%, or 99% sequence identity to SEQ ID NO: 6125).

86. The multifunctional molecule of any of embodiments 57-70, wherein the NK cell engager comprises a heavy chain variable region (VH) comprising a heavy chain framework region 1 (VHFWR1) amino acid sequence of SEQ ID NO: 6026 (or a sequence with no more than 1, 2, 3, 4, 5, or 6 mutations, e.g., substitutions, additions, or deletions, therefrom), a VHFWR2 amino acid sequence of SEQ ID NO: 6027 (or a sequence with no more than 1, 2, 3, 4, 5, or 6 mutations, e.g., substitutions, additions, or deletions, therefrom), a VHFWR3 amino acid sequence of SEQ ID NO: 6028 (or a sequence with no more than 1, 2, 3, 4, 5, or 6 mutations, e.g., substitutions, additions, or deletions, therefrom), or a VHFWR4 amino acid sequence of SEQ ID NO: 6029 (or a sequence with no more than 1, 2, 3, 4, 5, or 6 mutations, e.g., substitutions, additions, or deletions, therefrom).

87. The multifunctional molecule of embodiment 86, wherein the NK cell engager comprises a heavy chain variable region (VH) comprising a heavy chain framework region 1 (VHFWR1) amino acid sequence of SEQ ID NO: 6026, a VHFWR2 amino acid sequence of SEQ ID NO: 6027, a VHFWR3 amino acid sequence of SEQ ID NO: 6028, or a VHFWR4 amino acid sequence of SEQ ID NO: 6029.

88. The multifunctional molecule of embodiment 87, wherein the NK cell engager comprises a VH comprising the amino acid sequence of SEQ ID NO: 6126 (or an amino acid sequence having at least about 75%, 80%, 85%, 90%, 95%, or 99% sequence identity to SEQ ID NO: 6126).

89. The multifunctional molecule of any of embodiments 57-70, wherein the NK cell engager comprises a heavy chain variable region (VH) comprising a heavy chain framework region 1 (VHFWR1) amino acid sequence of SEQ ID NO: 6030 (or a sequence with no more than 1, 2, 3, 4, 5, or 6 mutations, e.g., substitutions, additions, or deletions, therefrom), a VHFWR2 amino acid sequence of SEQ ID NO: 6032 (or a sequence with no more than 1, 2, 3, 4, 5, or 6 mutations, e.g., substitutions, additions, or deletions, therefrom), a VHFWR3 amino acid sequence of SEQ ID NO: 6033 (or a sequence with no more than 1, 2, 3, 4, 5, or 6 mutations, e.g., substitutions, additions, or deletions, therefrom), or a VHFWR4 amino acid sequence of SEQ ID NO: 6034 (or a sequence with no more than 1, 2, 3, 4, 5, or 6 mutations, e.g., substitutions, additions, or deletions, therefrom).

90. The multifunctional molecule of embodiment 89, wherein the NK cell engager comprises a heavy chain variable region (VH) comprising a heavy chain framework region 1 (VHFWR1) amino acid sequence of SEQ ID NO: 6030, a VHFWR2 amino acid sequence of SEQ ID NO: 6032, a VHFWR3 amino acid sequence of SEQ ID NO: 6033, or a VHFWR4 amino acid sequence of SEQ ID NO: 6034.

91. The multifunctional molecule of embodiment 90, wherein the NK cell engager comprises a VH comprising the amino acid sequence of SEQ ID NO: 6127 (or an amino acid sequence having at least about 75%, 80%, 85%, 90%, 95%, or 99% sequence identity to SEQ ID NO: 6127).

92. The multifunctional molecule of any of embodiments 57-70, wherein the NK cell engager comprises a heavy chain variable region (VH) comprising a heavy chain framework region 1 (VHFWR1) amino acid sequence of SEQ ID NO: 6035 (or a sequence with no more than 1, 2, 3, 4, 5, or 6 mutations, e.g., substitutions, additions, or deletions, therefrom), a VHFWR2 amino acid sequence of SEQ ID NO: 6036 (or a sequence with no more than 1, 2, 3, 4, 5, or 6 mutations, e.g., substitutions, additions, or deletions, therefrom), a VHFWR3 amino acid sequence of SEQ ID NO: 6037 (or a sequence with no more than 1, 2, 3, 4, 5, or 6 mutations, e.g., substitutions, additions, or deletions, therefrom), or a VHFWR4 amino acid sequence of SEQ ID NO: 6038 (or a sequence with no more than 1, 2, 3, 4, 5, or 6 mutations, e.g., substitutions, additions, or deletions, therefrom).

93. The multifunctional molecule of embodiment 92, wherein the NK cell engager comprises a heavy chain variable region (VH) comprising a heavy chain framework region 1 (VHFWR1) amino acid sequence of SEQ ID NO: 6035, a VHFWR2 amino acid sequence of SEQ ID NO: 6036, a VHFWR3 amino acid sequence of SEQ ID NO: 6037, or a VHFWR4 amino acid sequence of SEQ ID NO: 6038.

94. The multifunctional molecule of embodiment 93, wherein the NK cell engager comprises a VH comprising the amino acid sequence of SEQ ID NO: 6128 (or an amino acid sequence having at least about 75%, 80%, 85%, 90%, 95%, or 99% sequence identity to SEQ ID NO: 6128).

95. The multifunctional molecule of any of embodiments 57-70 or 77-94, wherein the NK cell engager comprises a light chain variable region (VL) comprising a light chain framework region 1 (VLFWR1) amino acid sequence of SEQ ID NO: 6077 (or a sequence with no more than 1, 2, 3, 4, 5, or 6 mutations, e.g., substitutions, additions, or deletions, therefrom), a VLFWR2 amino acid sequence of SEQ ID NO: 6078 (or a sequence with no more than 1, 2, 3, 4, 5, or 6 mutations, e.g., substitutions, additions, or deletions, therefrom), a VLFWR3 amino acid sequence of SEQ ID NO: 6079 (or a sequence with no more than 1, 2, 3, 4, 5, or 6 mutations, e.g., substitutions, additions, or deletions, therefrom), or a VLFWR4 amino acid sequence of SEQ ID NO: 6080 (or a sequence with no more than 1, 2, 3, 4, 5, or 6 mutations, e.g., substitutions, additions, or deletions, therefrom).

96. The multifunctional molecule of embodiment 95, wherein the NK cell engager comprises a light chain variable region (VL) comprising a light chain framework region 1 (VLFWR1) amino acid sequence of SEQ ID NO: 6077, a VLFWR2 amino acid sequence of SEQ ID NO: 6078, a VLFWR3 amino acid sequence of SEQ ID NO: 6079, or a VLFWR4 amino acid sequence of SEQ ID NO: 6080.

97. The multifunctional molecule of embodiment 96, wherein the NK cell engager comprises a VL comprising the amino acid sequence of SEQ ID NO: 6137 (or an amino acid sequence having at least about 93%, 95%, or 99% sequence identity to SEQ ID NO: 6137).

98. The multifunctional molecule of any of embodiments 57-70 or 77-94, wherein the NK cell engager comprises a light chain variable region (VL) comprising a light chain framework region 1 (VLFWR1) amino acid sequence of SEQ ID NO: 6081 (or a sequence with no more than 1, 2, 3, 4, 5, or 6 mutations, e.g., substitutions, additions, or deletions, therefrom), a VLFWR2 amino acid sequence of SEQ ID NO: 6082 (or a sequence with no more than 1, 2, 3, 4, 5, or 6 mutations, e.g., substitutions, additions, or deletions, therefrom), a VLFWR3 amino acid sequence of SEQ ID NO: 6083 (or a sequence with no more than 1, 2, 3, 4, 5, or 6 mutations, e.g., substitutions, additions, or deletions, therefrom), or a VLFWR4 amino acid sequence of SEQ ID NO: 6084 (or a sequence with no more than 1, 2, 3, 4, 5, or 6 mutations, e.g., substitutions, additions, or deletions, therefrom).

99. The multifunctional molecule of embodiment 98, wherein the NK cell engager comprises a light chain variable region (VL) comprising a light chain framework region 1 (VLFWR1) amino acid sequence of SEQ ID NO: 6081, a VLFWR2 amino acid sequence of SEQ ID NO: 6082, a VLFWR3 amino acid sequence of SEQ ID NO: 6083, or a VLFWR4 amino acid sequence of SEQ ID NO: 6084.

100. The multifunctional molecule of embodiment 99, wherein the NK cell engager comprises a VL comprising the amino acid sequence of SEQ ID NO: 6138 (or an amino acid sequence having at least about 93%, 95%, or 99% sequence identity to SEQ ID NO: 6138).

101. The multifunctional molecule of any of embodiments 57-70 or 77-94, wherein the NK cell engager comprises a light chain variable region (VL) comprising a light chain framework region 1 (VLFWR1) amino acid sequence of SEQ ID NO: 6085 (or a sequence with no more than 1, 2, 3, 4, 5, or 6 mutations, e.g., substitutions, additions, or deletions, therefrom), a VLFWR2 amino acid sequence of SEQ ID NO: 6086 (or a sequence with no more than 1, 2, 3, 4, 5, or 6 mutations, e.g., substitutions, additions, or deletions, therefrom), a VLFWR3 amino acid sequence of SEQ ID NO: 6087 (or a sequence with no more than 1, 2, 3, 4, 5, or 6 mutations, e.g., substitutions, additions, or deletions, therefrom), or a VLFWR4 amino acid sequence of SEQ ID NO: 6088 (or a sequence with no more than 1, 2, 3, 4, 5, or 6 mutations, e.g., substitutions, additions, or deletions, therefrom).

102. The multifunctional molecule of embodiment 101, wherein the NK cell engager comprises a light chain variable region (VL) comprising a light chain framework region 1 (VLFWR1) amino acid sequence of SEQ ID NO: 6085, a VLFWR2 amino acid sequence of SEQ ID NO: 6086, a VLFWR3 amino acid sequence of SEQ ID NO: 6087, or a VLFWR4 amino acid sequence of SEQ ID NO: 6088.

103. The multifunctional molecule of embodiment 102, wherein the NK cell engager comprises a VL comprising the amino acid sequence of SEQ ID NO: 6139 (or an amino acid sequence having at least about 93%, 95%, or 99% sequence identity to SEQ ID NO: 6139).

104. The multifunctional molecule of any of embodiments 57-70 or 77-94, wherein the NK cell engager comprises a light chain variable region (VL) comprising a light chain framework region 1 (VLFWR1) amino acid sequence of SEQ ID NO: 6089 (or a sequence with no more than 1, 2, 3, 4, 5, or 6 mutations, e.g., substitutions, additions, or deletions, therefrom), a VLFWR2 amino acid sequence of SEQ ID NO: 6090 (or a sequence with no more than 1, 2, 3, 4, 5, or 6 mutations, e.g., substitutions, additions, or deletions, therefrom), a VLFWR3 amino acid sequence of SEQ ID NO: 6091 (or a sequence with no more than 1, 2, 3, 4, 5, or 6 mutations, e.g., substitutions, additions, or deletions, therefrom), or a VLFWR4 amino acid sequence of SEQ ID NO: 6092 (or a sequence with no more than 1, 2, 3, 4, 5, or 6 mutations, e.g., substitutions, additions, or deletions, therefrom).

105. The multifunctional molecule of embodiment 104, wherein the NK cell engager comprises a light chain variable region (VL) comprising a light chain framework region 1 (VLFWR1) amino acid sequence of SEQ ID NO: 6089, a VLFWR2 amino acid sequence of SEQ ID NO: 6090, a VLFWR3 amino acid sequence of SEQ ID NO: 6091, or a VLFWR4 amino acid sequence of SEQ ID NO: 6092.

106. The multifunctional molecule of embodiment 105, wherein the NK cell engager comprises a VL comprising the amino acid sequence of SEQ ID NO: 6140 (or an amino acid sequence having at least about 93%, 95%, or 99% sequence identity to SEQ ID NO: 6140).

107. The multifunctional molecule of any of embodiments 57-70 or 77-94, wherein the NK cell engager comprises a light chain variable region (VL) comprising a light chain framework region 1 (VLFWR1) amino acid sequence of SEQ ID NO: 6093 (or a sequence with no more than 1, 2, 3, 4, 5, or 6 mutations, e.g., substitutions, additions, or deletions, therefrom), a VLFWR2 amino acid sequence of SEQ ID NO: 6094 (or a sequence with no more than 1, 2, 3, 4, 5, or 6 mutations, e.g., substitutions, additions, or deletions, therefrom), a VLFWR3 amino acid sequence of SEQ ID NO: 6095 (or a sequence with no more than 1, 2, 3, 4, 5, or 6 mutations, e.g., substitutions, additions, or deletions, therefrom), or a VLFWR4 amino acid sequence of SEQ ID NO: 6096 (or a sequence with no more than 1, 2, 3, 4, 5, or 6 mutations, e.g., substitutions, additions, or deletions, therefrom).

108. The multifunctional molecule of embodiment 107, wherein the NK cell engager comprises a light chain variable region (VL) comprising a light chain framework region 1 (VLFWR1) amino acid sequence of SEQ ID NO: 6093, a VLFWR2 amino acid sequence of SEQ ID NO: 6094, a VLFWR3 amino acid sequence of SEQ ID NO: 6095, or a VLFWR4 amino acid sequence of SEQ ID NO: 6096.

109. The multifunctional molecule of embodiment 108, wherein the NK cell engager comprises a VL comprising the amino acid sequence of SEQ ID NO: 6141 (or an amino acid sequence having at least about 93%, 95%, or 99% sequence identity to SEQ ID NO: 6141).

110. The multifunctional molecule of any of embodiments 57-68, wherein the NK cell engager comprises:
(i) a heavy chain variable region (VH) comprising a heavy chain complementarity determining region 1 (VHCDR1) amino acid sequence of SEQ ID NO: 6007 (or a sequence with no more than 1, 2, 3, or 4 mutations, e.g., substitutions, additions, or deletions), a VHCDR2 amino acid sequence of SEQ ID NO: 6008 (or a sequence with no more than 1, 2, 3, or 4 mutations, e.g., substitutions, additions, or deletions), and/or a VHCDR3 amino acid sequence of SEQ ID NO: 6009 (or a sequence with no more than 1, 2, 3, or 4 mutations, e.g., substitutions, additions, or deletions), and
(ii) a light chain variable region (VL) comprising a light chain complementarity determining region 1 (VLCDR1) amino acid sequence of SEQ ID NO: 6070 (or a sequence with no more than 1, 2, 3, or 4 mutations, e.g., substitutions, additions, or deletions), a VLCDR2 amino acid sequence of SEQ ID NO: 6071 (or a sequence with no more than 1, 2, 3, or 4 mutations, e.g., substitutions, additions, or deletions), and/or a VLCDR3 amino acid sequence of SEQ ID NO: 6072 (or a sequence with no more than 1, 2, 3, or 4 mutations, e.g., substitutions, additions, or deletions).

111. The multifunctional molecule of embodiment 110, wherein the NK cell engager comprises:
(i) a heavy chain variable region (VH) comprising a heavy chain complementarity determining region 1 (VHCDR1) amino acid sequence of SEQ ID NO: 6007, a VHCDR2 amino acid sequence of SEQ ID NO: 6008, and/or a VHCDR3 amino acid sequence of SEQ ID NO: 6009, and (ii) a light chain variable region (VL) comprising a light chain complementarity determining region 1 (VLCDR1) amino acid sequence of SEQ ID NO: 6070, a VLCDR2 amino acid sequence of SEQ ID NO: 6071, and/or a VLCDR3 amino acid sequence of SEQ ID NO: 6072.

112. The multifunctional molecule of any of embodiments 57-68, 110, or 111, wherein the NK cell engager comprises:
(1) a heavy chain variable region (VH) comprising a heavy chain framework region 1 (VHFWR1) amino acid sequence of SEQ ID NO: 6010 (or a sequence with no more than 1, 2, 3, 4, 5, or 6 mutations, e.g., substitutions, additions, or deletions, therefrom), a VHFWR2 amino acid sequence of SEQ ID NO: 6011 (or a sequence with no more than 1, 2, 3, 4, 5, or 6 mutations, e.g., substitutions, additions, or deletions, therefrom), a VHFWR3 amino acid sequence of SEQ ID NO: 6012 (or a sequence with no more than 1, 2, 3, 4, 5, or 6 mutations, e.g., substitutions, additions, or deletions, therefrom), or a VHFWR4 amino acid sequence of SEQ ID NO: 6013 (or a sequence with no more than 1, 2, 3, 4, 5, or 6 mutations, e.g., substitutions, additions, or deletions, therefrom), and/or
(2) a light chain variable region (VL) comprising a light chain framework region 1 (VLFWR1) amino acid sequence of SEQ ID NO: 6073 (or a sequence with no more than 1, 2, 3, 4, 5, or 6 mutations, e.g., substitutions, additions, or deletions, therefrom), a VLFWR2 amino acid sequence of SEQ ID NO: 6074 (or a sequence with no more than 1, 2, 3, 4, 5, or 6 mutations, e.g., substitutions, additions, or deletions, therefrom), a VLFWR3 amino acid sequence of SEQ ID NO: 6075 (or a sequence with no more than 1, 2, 3, 4, 5, or 6 mutations, e.g., substitutions, additions, or deletions, therefrom), or a VLFWR4 amino acid sequence of SEQ ID NO: 6076 (or a sequence with no more than 1, 2, 3, 4, 5, or 6 mutations, e.g., substitutions, additions, or deletions, therefrom).

113. The multifunctional molecule of embodiment 112, wherein the NK cell engager comprises:
(1) a heavy chain variable region (VH) comprising a heavy chain framework region 1 (VHFWR1) amino acid sequence of SEQ ID NO: 6010, a VHFWR2 amino acid sequence of SEQ ID NO: 6011, a VHFWR3 amino acid sequence of SEQ ID NO: 6012, or a VHFWR4 amino acid sequence of SEQ ID NO: 6013, and
(3) a light chain variable region (VL) comprising a light chain framework region 1 (VLFWR1) amino acid sequence of SEQ ID NO: 6073, a VLFWR2 amino acid sequence of SEQ ID NO: 6074, a VLFWR3 amino acid sequence of SEQ ID NO: 6075, or a VLFWR4 amino acid sequence of SEQ ID NO: 6076.

114. The multifunctional molecule of any one of embodiments 57-68 or 110-113, wherein the NK cell engager comprises:
(i) a VH comprising the amino acid sequence of SEQ ID NO: 6122 (or an amino acid sequence having at least about 75%, 80%, 85%, 90%, 95%, or 99% sequence identity to SEQ ID NO: 6122), and/or
(ii) a VL comprising the amino acid sequence of SEQ ID NO: 6136 (or an amino acid sequence having at least about 93%, 95%, or 99% sequence identity to SEQ ID NO: 6136).

115. The multifunctional molecule of any of embodiments 57-68 or 110-114, wherein the NK cell engager comprises a heavy chain comprising the amino acid sequence of SEQ ID NOs: 6151 or 6152 (or an amino acid sequence having at least about 75%, 80%, 85%, 90%, 95%, or 99% sequence identity to SEQ ID NOs: 6151 or 6152).

116. The multifunctional molecule of any of embodiments 57-68 or 110-115, wherein the NK cell engager comprises a light chain comprising the amino acid sequence of SEQ ID NO: 6153 (or an amino acid sequence having at least about 75%, 80%, 85%, 90%, 95%, or 99% sequence identity to SEQ ID NO: 6153).

117. The multifunctional molecule of any of embodiments 57-68 or 110-116, wherein the NK cell engager comprises a heavy chain comprising the amino acid sequence of SEQ ID NOs: 6151 or 6152 (or an amino acid sequence having at least about 75%, 80%, 85%, 90%, 95%, or 99% sequence identity to SEQ ID NOs: 6151 or 6152), and a light chain comprising the amino acid sequence of SEQ ID NO: 6153 (or an amino acid sequence having at least about 75%, 80%, 85%, 90%, 95%, or 99% sequence identity to SEQ ID NO: 6153).

118. The multifunctional molecule of any of embodiments 57-68, 110, or 111, wherein the NK cell engager comprises a heavy chain variable region (VH) comprising a heavy chain framework region 1 (VHFWR1) amino acid sequence of SEQ ID NO: 6039 (or a sequence with no more than 1, 2, 3, 4, 5, or 6 mutations, e.g., substitutions, additions, or deletions, therefrom), a VHFWR2 amino acid sequence of SEQ ID NO: 6040 (or a sequence with no more than 1, 2, 3, 4, 5, or 6 mutations, e.g., substitutions, additions, or deletions, therefrom), a VHFWR3 amino acid sequence of SEQ ID NO: 6041 (or a sequence with no more than 1, 2, 3, 4, 5, or 6 mutations, e.g., substitutions, additions, or deletions, therefrom), or a VHFWR4 amino acid sequence of SEQ ID NO: 6042 (or a sequence with no more than 1, 2, 3, 4, 5, or 6 mutations, e.g., substitutions, additions, or deletions, therefrom).

119. The multifunctional molecule of embodiment 118, wherein the NK cell engager comprises a heavy chain variable region (VH) comprising a heavy chain framework region 1 (VHFWR1) amino acid sequence of SEQ ID NO: 6039, a VHFWR2 amino acid sequence of SEQ ID NO: 6040, a VHFWR3 amino acid sequence of SEQ ID NO: 6041, or a VHFWR4 amino acid sequence of SEQ ID NO: 6042.

120. The multifunctional molecule of embodiment 119, wherein the NK cell engager comprises a VH comprising the amino acid sequence of SEQ ID NO: 6129 (or an amino acid sequence having at least about 75%, 80%, 85%, 90%, 95%, or 99% sequence identity to SEQ ID NO: 6129).

121. The multifunctional molecule of any of embodiments 57-68, 110, or 111, wherein the NK cell engager comprises a heavy chain variable region (VH) comprising a heavy chain framework region 1 (VHFWR1) amino acid sequence of SEQ ID NO: 6043 (or a sequence with no more than 1, 2, 3, 4, 5, or 6 mutations, e.g., substitutions, additions, or deletions, therefrom), a VHFWR2 amino acid sequence of SEQ ID NO: 6044 (or a sequence with no more than 1, 2, 3, 4, 5, or 6 mutations, e.g., substitutions, additions, or deletions, therefrom), a VHFWR3 amino acid sequence of SEQ ID NO: 6045 (or a sequence with no more than 1, 2, 3, 4, 5, or 6 mutations, e.g., substitutions, additions, or deletions, therefrom), or a VHFWR4 amino acid sequence of SEQ ID NO: 6046 (or a sequence with no more than 1, 2, 3, 4, 5, or 6 mutations, e.g., substitutions, additions, or deletions, therefrom).

122. The multifunctional molecule of embodiment 121, wherein the NK cell engager comprises a heavy chain variable region (VH) comprising a heavy chain framework region 1 (VHFWR1) amino acid sequence of SEQ ID NO:

6043, a VHFWR2 amino acid sequence of SEQ ID NO: 6044, a VHFWR3 amino acid sequence of SEQ ID NO: 6045, or a VHFWR4 amino acid sequence of SEQ ID NO: 6046.

123. The multifunctional molecule of embodiment 122, wherein the NK cell engager comprises a VH comprising the amino acid sequence of SEQ ID NO: 6130 (or an amino acid sequence having at least about 75%, 80%, 85%, 90%, 95%, or 99% sequence identity to SEQ ID NO: 6130).

124. The multifunctional molecule of any of embodiments 57-68, 110, or 111, wherein the NK cell engager comprises a heavy chain variable region (VH) comprising a heavy chain framework region 1 (VHFWR1) amino acid sequence of SEQ ID NO: 6047 (or a sequence with no more than 1, 2, 3, 4, 5, or 6 mutations, e.g., substitutions, additions, or deletions, therefrom), a VHFWR2 amino acid sequence of SEQ ID NO: 6048 (or a sequence with no more than 1, 2, 3, 4, 5, or 6 mutations, e.g., substitutions, additions, or deletions, therefrom), a VHFWR3 amino acid sequence of SEQ ID NO: 6049 (or a sequence with no more than 1, 2, 3, 4, 5, or 6 mutations, e.g., substitutions, additions, or deletions, therefrom), or a VHFWR4 amino acid sequence of SEQ ID NO: 6050 (or a sequence with no more than 1, 2, 3, 4, 5, or 6 mutations, e.g., substitutions, additions, or deletions, therefrom).

125. The multifunctional molecule of embodiment 124, wherein the NK cell engager comprises a heavy chain variable region (VH) comprising a heavy chain framework region 1 (VHFWR1) amino acid sequence of SEQ ID NO: 6047, a VHFWR2 amino acid sequence of SEQ ID NO: 6048, a VHFWR3 amino acid sequence of SEQ ID NO: 6049, or a VHFWR4 amino acid sequence of SEQ ID NO: 6050.

126. The multifunctional molecule of embodiment 125, wherein the NK cell engager comprises a VH comprising the amino acid sequence of SEQ ID NO: 6131 (or an amino acid sequence having at least about 75%, 80%, 85%, 90%, 95%, or 99% sequence identity to SEQ ID NO: 6131).

127. The multifunctional molecule of any of embodiments 57-68, 110, or 111, wherein the NK cell engager comprises a heavy chain variable region (VH) comprising a heavy chain framework region 1 (VHFWR1) amino acid sequence of SEQ ID NO: 6051 (or a sequence with no more than 1, 2, 3, 4, 5, or 6 mutations, e.g., substitutions, additions, or deletions, therefrom), a VHFWR2 amino acid sequence of SEQ ID NO: 6052 (or a sequence with no more than 1, 2, 3, 4, 5, or 6 mutations, e.g., substitutions, additions, or deletions, therefrom), a VHFWR3 amino acid sequence of SEQ ID NO: 6053 (or a sequence with no more than 1, 2, 3, 4, 5, or 6 mutations, e.g., substitutions, additions, or deletions, therefrom), or a VHFWR4 amino acid sequence of SEQ ID NO: 6054 (or a sequence with no more than 1, 2, 3, 4, 5, or 6 mutations, e.g., substitutions, additions, or deletions, therefrom).

128. The multifunctional molecule of embodiment 127, wherein the NK cell engager comprises a heavy chain variable region (VH) comprising a heavy chain framework region 1 (VHFWR1) amino acid sequence of SEQ ID NO: 6051, a VHFWR2 amino acid sequence of SEQ ID NO: 6052, a VHFWR3 amino acid sequence of SEQ ID NO: 6053, or a VHFWR4 amino acid sequence of SEQ ID NO: 6054.

129. The multifunctional molecule of embodiment 128, wherein the NK cell engager comprises a VH comprising the amino acid sequence of SEQ ID NO: 6132 (or an amino acid sequence having at least about 75%, 80%, 85%, 90%, 95%, or 99% sequence identity to SEQ ID NO: 6132).

130. The multifunctional molecule of any of embodiments 57-68, 110, or 111, wherein the NK cell engager comprises a heavy chain variable region (VH) comprising a heavy chain framework region 1 (VHFWR1) amino acid sequence of SEQ ID NO: 6055 (or a sequence with no more than 1, 2, 3, 4, 5, or 6 mutations, e.g., substitutions, additions, or deletions, therefrom), a VHFWR2 amino acid sequence of SEQ ID NO: 6056 (or a sequence with no more than 1, 2, 3, 4, 5, or 6 mutations, e.g., substitutions, additions, or deletions, therefrom), a VHFWR3 amino acid sequence of SEQ ID NO: 6057 (or a sequence with no more than 1, 2, 3, 4, 5, or 6 mutations, e.g., substitutions, additions, or deletions, therefrom), or a VHFWR4 amino acid sequence of SEQ ID NO: 6058 (or a sequence with no more than 1, 2, 3, 4, 5, or 6 mutations, e.g., substitutions, additions, or deletions, therefrom).

131. The multifunctional molecule of embodiment 130, wherein the NK cell engager comprises a heavy chain variable region (VH) comprising a heavy chain framework region 1 (VHFWR1) amino acid sequence of SEQ ID NO: 6055, a VHFWR2 amino acid sequence of SEQ ID NO: 6056, a VHFWR3 amino acid sequence of SEQ ID NO: 6057, or a VHFWR4 amino acid sequence of SEQ ID NO: 6058.

132. The multifunctional molecule of embodiment 131, wherein the NK cell engager comprises a VH comprising the amino acid sequence of SEQ ID NO: 6133 (or an amino acid sequence having at least about 75%, 80%, 85%, 90%, 95%, or 99% sequence identity to SEQ ID NO: 6133).

133. The multifunctional molecule of any of embodiments 57-68, 110, or 111, wherein the NK cell engager comprises a heavy chain variable region (VH) comprising a heavy chain framework region 1 (VHFWR1) amino acid sequence of SEQ ID NO: 6059 (or a sequence with no more than 1, 2, 3, 4, 5, or 6 mutations, e.g., substitutions, additions, or deletions, therefrom), a VHFWR2 amino acid sequence of SEQ ID NO: 6060 (or a sequence with no more than 1, 2, 3, 4, 5, or 6 mutations, e.g., substitutions, additions, or deletions, therefrom), a VHFWR3 amino acid sequence of SEQ ID NO: 6061 (or a sequence with no more than 1, 2, 3, 4, 5, or 6 mutations, e.g., substitutions, additions, or deletions, therefrom), or a VHFWR4 amino acid sequence of SEQ ID NO: 6062 (or a sequence with no more than 1, 2, 3, 4, 5, or 6 mutations, e.g., substitutions, additions, or deletions, therefrom).

134. The multifunctional molecule of embodiment 133, wherein the NK cell engager comprises a heavy chain variable region (VH) comprising a heavy chain framework region 1 (VHFWR1) amino acid sequence of SEQ ID NO: 6059, a VHFWR2 amino acid sequence of SEQ ID NO: 6060, a VHFWR3 amino acid sequence of SEQ ID NO: 6061, or a VHFWR4 amino acid sequence of SEQ ID NO: 6062.

135. The multifunctional molecule of embodiment 134, wherein the NK cell engager comprises a VH comprising the amino acid sequence of SEQ ID NO: 6134 (or an amino acid sequence having at least about 75%, 80%, 85%, 90%, 95%, or 99% sequence identity to SEQ ID NO: 6134).

136. The multifunctional molecule of any of embodiments 57-68, 110, 111, or 118-135, wherein the NK cell engager comprises a light chain variable region (VL) comprising a light chain framework region 1 (VLFWR1) amino acid sequence of SEQ ID NO: 6097 (or a sequence with no more than 1, 2, 3, 4, 5, or 6 mutations, e.g., substitutions, additions, or deletions, therefrom), a VLFWR2 amino acid sequence of SEQ ID NO: 6098 (or a sequence with no more than 1, 2, 3, 4, 5, or 6 mutations, e.g., substitutions, additions, or deletions, therefrom), a VLFWR3 amino acid sequence of SEQ ID NO: 6099 (or a sequence with no more than 1, 2, 3, 4, 5, or 6 mutations, e.g., substitutions, additions, or deletions, therefrom), or a VLFWR4 amino acid sequence of SEQ ID NO: 6100 (or a sequence with no more than 1, 2, 3, 4, 5, or 6 mutations, e.g., substitutions, additions, or deletions, therefrom).

137. The multifunctional molecule of embodiment 136, wherein the NK cell engager comprises a light chain variable region (VL) comprising a light chain framework region 1 (VLFWR1) amino acid sequence of SEQ ID NO: 6097, a VLFWR2 amino acid sequence of SEQ ID NO: 6098, a VLFWR3 amino acid sequence of SEQ ID NO: 6099, or a VLFWR4 amino acid sequence of SEQ ID NO: 6100.

138. The multifunctional molecule of embodiment 137, wherein the NK cell engager comprises a VL comprising the amino acid sequence of SEQ ID NO: 6142 (or an amino acid sequence having at least about 93%, 95%, or 99% sequence identity to SEQ ID NO: 6142).

139. The multifunctional molecule of any of embodiments 57-68, 110, 111, or 118-135, wherein the NK cell engager comprises a light chain variable region (VL) comprising a light chain framework region 1 (VLFWR1) amino acid sequence of SEQ ID NO: 6101 (or a sequence with no more than 1, 2, 3, 4, 5, or 6 mutations, e.g., substitutions, additions, or deletions, therefrom), a VLFWR2 amino acid sequence of SEQ ID NO: 6102 (or a sequence with no more than 1, 2, 3, 4, 5, or 6 mutations, e.g., substitutions, additions, or deletions, therefrom), a VLFWR3 amino acid sequence of SEQ ID NO: 6103 (or a sequence with no more than 1, 2, 3, 4, 5, or 6 mutations, e.g., substitutions, additions, or deletions, therefrom), or a VLFWR4 amino acid sequence of SEQ ID NO: 6104 (or a sequence with no more than 1, 2, 3, 4, 5, or 6 mutations, e.g., substitutions, additions, or deletions, therefrom).

140. The multifunctional molecule of embodiment 139, wherein the NK cell engager comprises a light chain variable region (VL) comprising a light chain framework region 1 (VLFWR1) amino acid sequence of SEQ ID NO: 6101, a VLFWR2 amino acid sequence of SEQ ID NO: 6102, a VLFWR3 amino acid sequence of SEQ ID NO: 6103, or a VLFWR4 amino acid sequence of SEQ ID NO: 6104.

141. The multifunctional molecule of embodiment 140, wherein the NK cell engager comprises a VL comprising the amino acid sequence of SEQ ID NO: 6143 (or an amino acid sequence having at least about 93%, 95%, or 99% sequence identity to SEQ ID NO: 6143).

142. The multifunctional molecule of any of embodiments 57-68, 110, 111, or 118-135, wherein the NK cell engager comprises a light chain variable region (VL) comprising a light chain framework region 1 (VLFWR1) amino acid sequence of SEQ ID NO: 6105 (or a sequence with no more than 1, 2, 3, 4, 5, or 6 mutations, e.g., substitutions, additions, or deletions, therefrom), a VLFWR2 amino acid sequence of SEQ ID NO: 6106 (or a sequence with no more than 1, 2, 3, 4, 5, or 6 mutations, e.g., substitutions, additions, or deletions, therefrom), a VLFWR3 amino acid sequence of SEQ ID NO: 6107 (or a sequence with no more than 1, 2, 3, 4, 5, or 6 mutations, e.g., substitutions, additions, or deletions, therefrom), or a VLFWR4 amino acid sequence of SEQ ID NO: 6108 (or a sequence with no more than 1, 2, 3, 4, 5, or 6 mutations, e.g., substitutions, additions, or deletions, therefrom).

143. The multifunctional molecule of embodiment 142, wherein the NK cell engager comprises a light chain variable region (VL) comprising a light chain framework region 1 (VLFWR1) amino acid sequence of SEQ ID NO: 6105, a VLFWR2 amino acid sequence of SEQ ID NO: 6106, a VLFWR3 amino acid sequence of SEQ ID NO: 6107, or a VLFWR4 amino acid sequence of SEQ ID NO: 6108.

144. The multifunctional molecule of embodiment 143, wherein the NK cell engager comprises a VL comprising the amino acid sequence of SEQ ID NO: 6144 (or an amino acid sequence having at least about 93%, 95%, or 99% sequence identity to SEQ ID NO: 6144).

145. The multifunctional molecule of any of embodiments 57-68, 110, 111, or 118-135, wherein the NK cell engager comprises a light chain variable region (VL) comprising a light chain framework region 1 (VLFWR1) amino acid sequence of SEQ ID NO: 6109 (or a sequence with no more than 1, 2, 3, 4, 5, or 6 mutations, e.g., substitutions, additions, or deletions, therefrom), a VLFWR2 amino acid sequence of SEQ ID NO: 6110 (or a sequence with no more than 1, 2, 3, 4, 5, or 6 mutations, e.g., substitutions, additions, or deletions, therefrom), a VLFWR3 amino acid sequence of SEQ ID NO: 6111 (or a sequence with no more than 1, 2, 3, 4, 5, or 6 mutations, e.g., substitutions, additions, or deletions, therefrom), or a VLFWR4 amino acid sequence of SEQ ID NO: 6112 (or a sequence with no more than 1, 2, 3, 4, 5, or 6 mutations, e.g., substitutions, additions, or deletions, therefrom).

146. The multifunctional molecule of embodiment 145, wherein the NK cell engager comprises a light chain variable region (VL) comprising a light chain framework region 1 (VLFWR1) amino acid sequence of SEQ ID NO: 6109, a VLFWR2 amino acid sequence of SEQ ID NO: 6110, a VLFWR3 amino acid sequence of SEQ ID NO: 6111, or a VLFWR4 amino acid sequence of SEQ ID NO: 6112.

147. The multifunctional molecule of embodiments 146, wherein the NK cell engager comprises a VL comprising the amino acid sequence of SEQ ID NO: 6145 (or an amino acid sequence having at least about 93%, 95%, or 99% sequence identity to SEQ ID NO: 6145).

148. The multifunctional molecule of any of embodiments 57-68, 110, 111, or 118-135, wherein the NK cell engager comprises a light chain variable region (VL) comprising a light chain framework region 1 (VLFWR1) amino acid sequence of SEQ ID NO: 6113 (or a sequence with no more than 1, 2, 3, 4, 5, or 6 mutations, e.g., substitutions, additions, or deletions, therefrom), a VLFWR2 amino acid sequence of SEQ ID NO: 6114 (or a sequence with no more than 1, 2, 3, 4, 5, or 6 mutations, e.g., substitutions, additions, or deletions, therefrom), a VLFWR3 amino acid sequence of SEQ ID NO: 6115 (or a sequence with no more than 1, 2, 3, 4, 5, or 6 mutations, e.g., substitutions, additions, or deletions, therefrom), or a VLFWR4 amino acid sequence of SEQ ID NO: 6116 (or a sequence with no more than 1, 2, 3, 4, 5, or 6 mutations, e.g., substitutions, additions, or deletions, therefrom).

149. The multifunctional molecule of embodiment 148, wherein the NK cell engager comprises a light chain variable region (VL) comprising a light chain framework region 1 (VLFWR1) amino acid sequence of SEQ ID NO: 6113, a VLFWR2 amino acid sequence of SEQ ID NO: 6114, a VLFWR3 amino acid sequence of SEQ ID NO: 6115, or a VLFWR4 amino acid sequence of SEQ ID NO: 6116.

150. The multifunctional molecule of embodiment 149, wherein the NK cell engager comprises a VL comprising the amino acid sequence of SEQ ID NO: 6146 (or an amino acid sequence having at least about 93%, 95%, or 99% sequence identity to SEQ ID NO: 6146).

151. The multifunctional molecule of any of embodiments 57-68, 110, 111, or 118-135, wherein the NK cell engager comprises a light chain variable region (VL) comprising a light chain framework region 1 (VLFWR1) amino acid sequence of SEQ ID NO: 6117 (or a sequence with no more than 1, 2, 3, 4, 5, or 6 mutations, e.g., substitutions, additions, or deletions, therefrom), a VLFWR2 amino acid sequence of SEQ ID NO: 6118 (or a sequence with no more than 1, 2, 3, 4, 5, or 6 mutations, e.g., substitutions, additions, or deletions, therefrom), a VLFWR3 amino acid sequence of SEQ ID NO: 6119 (or a sequence with no more than 1, 2, 3, 4, 5, or 6 mutations, e.g., substitutions, additions, or deletions, therefrom), or a VLFWR4 amino acid sequence of SEQ ID NO: 6120 (or a sequence with no more than 1, 2, 3, 4, 5, or 6 mutations, e.g., substitutions, additions, or deletions, therefrom).

152. The multifunctional molecule of embodiment 151, wherein the NK cell engager comprises a light chain variable region (VL) comprising a light chain framework region 1 (VLFWR1) amino acid sequence of SEQ ID NO: 6117, a VLFWR2 amino acid sequence of SEQ ID NO: 6118, a VLFWR3 amino acid sequence of SEQ ID NO: 6119, or a VLFWR4 amino acid sequence of SEQ ID NO: 6120.

153. The multifunctional molecule of embodiment 152, wherein the NK cell engager comprises a VL comprising the amino acid sequence of SEQ ID NO: 6147 (or an amino acid sequence having at least about 93%, 95%, or 99% sequence identity to SEQ ID NO: 6147).

154. The multifunctional molecule of any of embodiments 57-60, wherein the NK cell engager is an antibody molecule, e.g., an antigen binding domain, that binds to NKp46.

155. The multifunctional molecule of embodiment 154, wherein lysis of the lymphoma cell is mediated by NKp46.

156. The multifunctional molecule of either of embodiments 154 or 155, wherein the multifunctional molecule does not activate the NK cell when incubated with the NK cell in the absence of the tumor antigen on the lymphoma cell.

157. The multifunctional molecule of any one of embodiments 154-156, wherein the multifunctional molecule activates the NK cell when the NK cell is a NKp46 expressing NK cell and the tumor antigen on the lymphoma cell is also present.

158. The multifunctional molecule of any one of embodiments 154-157, wherein the multifunctional molecule does not activate the NK cell when the NK cell is not a NKp46 expressing NK cell and the tumor antigen on the lymphoma cell is also present.

159. The multifunctional molecule of any one of embodiments 154-158, wherein the NK cell engager comprises a VH comprising the amino acid sequence of SEQ ID NO: 6182 (or an amino acid sequence having at least about 75%, 80%, 85%, 90%, 95%, or 99% sequence identity to SEQ ID NO: 6182).

160. The multifunctional molecule of any one of embodiments 154-159, wherein the NK cell engager comprises a VL comprising the amino acid sequence of SEQ ID NO: 6183 (or an amino acid sequence having at least about 93%, 95%, or 99% sequence identity to SEQ ID NO: 6183).

161. The multifunctional molecule of 154-160, wherein the NK cell engager comprises an scFv comprising the amino acid sequence of SEQ ID NO: 6181 (or an amino acid sequence having at least 93%, 95%, or 99% sequence identity to SEQ ID NO: 6181).

162. The multifunctional molecule of any of embodiments 57-60, wherein the NK cell engager is an antibody molecule, e.g., an antigen binding domain, that binds to NKG2D.

163. The multifunctional molecule of embodiment 162, wherein lysis of the lymphoma cell is mediated by NKG2D.

164. The multifunctional molecule of either of embodiments 162 or 163, wherein the multifunctional molecule does not activate the NK cell when incubated with the NK cell in the absence of the tumor antigen on the lymphoma cell.

165. The multifunctional molecule of any one of embodiments 162-164, wherein the multifunctional molecule activates the NK cell when the NK cell is a NKG2D expressing NK cell and the tumor antigen on the lymphoma cell is also present.

166. The multifunctional molecule of any one of embodiments 162-165, wherein the multifunctional molecule does not activate the NK cell when the NK cell is not a NKG2D expressing NK cell and the tumor antigen on the lymphoma cell is also present.

167. The multifunctional molecule of any one of embodiments 162-166, wherein the NK cell engager comprises a VH comprising the amino acid sequence of SEQ ID NO: 6176 (or an amino acid sequence having at least about 75%, 80%, 85%, 90%, 95%, or 99% sequence identity to SEQ ID NO: 6176).

168. The multifunctional molecule of any one of embodiments 162-167, wherein the NK cell engager comprises a VL comprising the amino acid sequence of SEQ ID NO: 6177 (or an amino acid sequence having at least about 93%, 95%, or 99% sequence identity to SEQ ID NO: 6177).

169. The multifunctional molecule of any of embodiments 162-168, wherein the NK cell engager comprises an scFv comprising the amino acid sequence of SEQ ID NO: 6175 (or an amino acid sequence having at least about 93%, 95%, or 99% sequence identity to SEQ ID NO: 6175).

170. The multifunctional molecule of any one of embodiments 162-166, wherein the NK cell engager comprises a VH comprising the amino acid sequence of SEQ ID NO: 6179 (or an amino acid sequence having at least about 75%, 80%, 85%, 90%, 95%, or 99% sequence identity to SEQ ID NO: 6179).

171. The multifunctional molecule of any one of embodiments 162-166 or 170 wherein the NK cell engager comprises a VL comprising the amino acid sequence of SEQ ID NO: 6180 (or an amino acid sequence having at least about 93%, 95%, or 99% sequence identity to SEQ ID NO: 6180).

172. The multifunctional molecule of any one of embodiments 162-166, 170, or 171, wherein the NK cell engager comprises an scFv comprising the amino acid sequence of SEQ ID NO: 6178 (or an amino acid sequence having at least about 93%, 95%, or 99% sequence identity to SEQ ID NO: 6178).

173. The multifunctional molecule of any of embodiments 57-60, wherein the NK cell engager is an antibody molecule, e.g., an antigen binding domain, that binds to CD16.

174. The multifunctional molecule of embodiment 162, wherein lysis of the lymphoma cell is mediated by CD16.

175. The multifunctional molecule of either of embodiments 173 or 174, wherein the multifunctional molecule does not activate the NK cell when incubated with the NK cell in the absence of the tumor antigen on the lymphoma cell.

176. The multifunctional molecule of any one of embodiments 173-175, wherein the multifunctional molecule activates the NK cell when the NK cell is a CD16 expressing NK cell and the tumor antigen on the lymphoma cell is also present.

177. The multifunctional molecule of any one of embodiments 173-176, wherein the multifunctional molecule does not activate the NK cell when the NK cell is not a CD16 expressing NK cell and the tumor antigen on the lymphoma cell is also present.

178. The multifunctional molecule of any one of embodiments 173-177, wherein the NK cell engager comprises a VH comprising the amino acid sequence of SEQ ID NO: 6185 (or an amino acid sequence having at least about 75%, 80%, 85%, 90%, 95%, or 99% sequence identity to SEQ ID NO: 6185).

179. The multifunctional molecule of any one of embodiments 173-178, wherein the NK cell engager comprises a VL comprising the amino acid sequence of SEQ ID NO: 6186 (or an amino acid sequence having at least about 93%, 95%, or 99% sequence identity to SEQ ID NO: 6186).

180. The multifunctional molecule of any of embodiments 173-179, wherein the NK cell engager comprises an scFv comprising the amino acid sequence of SEQ ID NO: 6184 (or an amino acid sequence having at least about 93%, 95%, or 99% sequence identity to SEQ ID NO: 6184).

181. The multifunctional molecule of embodiment 57, wherein the NK cell engager is a ligand, optionally, the ligand further comprises an immunoglobulin constant region, e.g., an Fc region.

182. The multifunctional molecule of embodiment 181, wherein the NK cell engager is a ligand of NKp44 or NKp46, e.g., a viral HA.

183. The multifunctional molecule of embodiment 181, wherein the NK cell engager is a ligand of DAP10, e.g., a coreceptor for NKG2D.

184. The multifunctional molecule of embodiment 181, wherein the NK cell engager is a ligand of CD16, e.g., a CD16a/b ligand, e.g., a CD16a/b ligand further comprising an antibody Fc region.

185. The multifunctional molecule of any one of embodiments 52-54, wherein the immune cell engager mediates binding to, or activation of, or both of, one or more of a B cell, a macrophage, and/or a dendritic cell.

186. The multifunctional molecule of embodiment 185, wherein the immune cell engager comprises a B cell, macrophage, and/or dendritic cell engager chosen from one or more of CD40 ligand (CD40L) or a CD70 ligand; an antibody molecule that binds to CD40 or CD70; an antibody molecule to OX40; an OX40 ligand (OX40L); an agonist of a Toll-like receptor (e.g., a TLR4, e.g., a constitutively active TLR4 (caTLR4) or a TLR9 agonist); a 41BB; a CD2 agonist; a CD47; or a STING agonist, or a combination thereof.

187. The multifunctional molecule of any one of embodiments 52-54, wherein the immune cell engager is a B cell engager, e.g., a CD40L, an OX40L, or a CD70 ligand, or an antibody molecule that binds to OX40, CD40 or CD70.

188. The multifunctional molecule of any one of embodiments 52-54, wherein the immune cell engager is a macrophage cell engager, e.g., a CD2 agonist; a CD40L; an OX40L; an antibody molecule that binds to OX40, CD40 or CD70; an agonist of a Toll-like receptor (TLR) (e.g., a TLR4, e.g., a constitutively active TLR4 (caTLR4) or a TLR9 agonist); CD47; or a STING agonist.

189. The multifunctional molecule of any one of embodiments 52-54, wherein the immune cell engager is a dendritic cell engager, e.g., a CD2 agonist, an OX40 antibody, an OX40L, 41BB agonist, a Toll-like receptor agonist or a fragment thereof (e.g., a TLR4, e.g., a constitutively active TLR4 (caTLR4)), CD47 agonist, or a STING agonist.

190. The multifunctional molecule of embodiment 188 or 189, wherein the STING agonist comprises a cyclic dinucleotide, e.g., a cyclic di-GMP (cdGMP), a cyclic di-AMP (cdAMP), or a combination thereof, optionally with 2',5' or 3',5' phosphate linkages, e.g., wherein the STING agonist is covalently coupled to the multifunctional molecule.

191. The multifunctional molecule of any one of embodiments 1-51, wherein the multifunctional molecule comprises a cytokine molecule.

192. The multifunctional molecule of embodiment 191, wherein the cytokine molecule is chosen from interleukin-2 (IL-2), interleukin-7 (IL-7), interleukin-12 (IL-12), interleukin-15 (IL-15), interleukin-18 (IL-18), interleukin-21 (IL-21), or interferon gamma, or a fragment or variant thereof, or a combination of any of the aforesaid cytokines.

192A. The multifunctional molecule of embodiment 192, wherein the cytokine molecule is interleukin-2 (IL-2).

193. The multifunctional molecule of embodiment 191 or 192, wherein the cytokine molecule is a monomer or a dimer.

194. The multifunctional molecule of any one of embodiments 191-193, wherein the cytokine molecule further comprises a receptor dimerizing domain, e.g., an IL15Ralpha dimerizing domain.

195. The multifunctional molecule of embodiment 194, wherein the cytokine molecule (e.g., IL-15) and the receptor dimerizing domain (e.g., an IL15Ralpha dimerizing domain) are not covalently linked, e.g., are non-covalently associated.

196. The multifunctional molecule of any of embodiments 1-51, wherein the multifunctional molecule comprises a cytokine inhibitor molecule.

197. The multifunctional molecule of embodiment 196, wherein the cytokine inhibitor molecule is a TGF-beta inhibitor.

198. The multifunctional molecule of either of embodiments 196 or 197, wherein the TGF-beta inhibitor inhibits (e.g., reduces the activity of): (i) TGF-beta 1; (ii) TGF-beta 2; (iii) TGF-beta 3; (iv) (i) and (ii); (v) (i) and (iii); (vi) (ii) and (iii); or (vii) (i), (ii), and (iii).

199. The multifunctional molecule of any of embodiments 196-198, wherein the TGF-beta inhibitor comprises a portion of a TGF-beta receptor (e.g., an extracellular domain of a TGF-beta receptor) that is capable of inhibiting (e.g., reducing the activity of) TGF-beta, or functional fragment or variant thereof.

200. The multifunctional molecule of embodiment 199, wherein the TGF-beta inhibitor comprises a portion of (i) TGFBR1; (ii) TGFBR2; (iii) TGFBR3; (iv) (i) and (ii); (v) (i) and (iii); (vi) (ii) and (iii); or (vii) (i), (ii), and (iii).

201. The multifunctional molecule of any of embodiments 196-200, wherein the TGF-beta inhibitor comprises an amino acid sequence selected from Table 16, or an amino acid sequence having at least about 93%, 95%, or 99% sequence identity thereto.

202. The multifunctional molecule of any of embodiments 1-51, wherein the multifunctional molecule comprises a death receptor signal engager chosen from a TNF-related apoptosis-inducing ligand (TRAIL) molecule, a death receptor molecule, or an antigen binding domain that specifically binds to a death receptor.

203. The multifunctional molecule of embodiment 202, wherein the death receptor signal engager activates death receptor signaling in the lymphoma cell (e.g., T cell) or lymphocyte expressing TRBC1 or TRBC2, e.g., and induces apoptosis or cell death in said cell.

204. The multifunctional molecule of either of embodiments 202 or 203, wherein the death receptor signal engager does not activate death receptor signaling on non-lymphoma cells and lymphocytes not expressing TRBC1 or not expressing TRBC2.

205. The multifunctional molecule of any of embodiments 202-204, wherein the death receptor signal engager comprises a TRAIL molecule, e.g., one or more TRAIL polypeptides or a fragment thereof.

206. The multifunctional molecule of embodiment 205, wherein the TRAIL molecule specifically binds to Death Receptor 4 (DR4) or Death Receptor 5 (DR5).

207. The multifunctional molecule of either of embodiments 205 or 206, wherein the TRAIL molecule comprises a truncated TRAIL polypeptide, e.g., relative to a wild-type TRAIL polypeptide.

208. The multifunctional molecule of embodiment 207, wherein the TRAIL molecule comprises at least residues corresponding to amino acids 95-281 of human TRAIL, e.g., a truncated TRAIL molecule comprising residues corresponding to amino acids 95-281 of human TRAIL.

209. The multifunctional molecule of embodiment 208, wherein the TRAIL molecule comprises a truncated TRAIL polypeptide comprising amino acids 95-281 of human TRAIL, e.g., and not amino acids 1-94 of human TRAIL.

210. The multifunctional molecule of embodiment 207, wherein the TRAIL molecule comprises at least residues corresponding to amino acids 122-281 of human TRAIL, e.g., a truncated TRAIL molecule comprising residues corresponding to amino acids 122-281 of human TRAIL.

211. The multifunctional molecule of embodiment 210, wherein the TRAIL molecule comprises a truncated TRAIL polypeptide comprising amino acids 122-281 of human TRAIL, e.g., and not amino acids 1-121 of human TRAIL.

212. The multifunctional molecule of any of embodiments 205-211, wherein the death receptor signal engager comprises one, two, or three TRAIL molecules.

213. The multifunctional molecule of any of embodiments 202-204, wherein the death receptor signal engager comprises an antigen binding domain that specifically binds to a death receptor, e.g., Death Receptor 4 (DR4) or Death Receptor 5 (DR5).

214. The multifunctional molecule of embodiment 213, wherein the death receptor signal engager comprises one, two, or three antigen binding domains that specifically binds to a death receptor.

215. The multifunctional molecule of either of embodiments 213 or 214, wherein the antigen binding domain that specifically binds to a death receptor binds to DR5.

216. The multifunctional molecule of any of embodiments 213-215, wherein the antigen binding domain that specifically binds to a death receptor comprises tigatuzumab, drozitumab, or conatumumab.

217. The multifunctional molecule of any of embodiments 202-216, wherein the death receptor signal engager comprises an amino acid sequence selected from Table 11, or an amino acid sequence having at least about 75%, 80%, 85%, 90%, 95%, or 99% sequence identity thereto.

218. The multifunctional molecule of any of embodiments 202-217, wherein the death receptor signal engager comprises an amino acid sequence of SEQ ID NO: 6157, or an amino acid sequence having at least about 75%, 80%, 85%, 90%, 95%, or 99% sequence identity thereto.

219. The multifunctional molecule of any of embodiments 202-217, wherein the death receptor signal engager comprises an amino acid sequence of SEQ ID NO: 6158, or an amino acid sequence having at least about 75%, 80%, 85%, 90%, 95%, or 99% sequence identity thereto.

220. The multifunctional molecule of any of embodiments 202-217, wherein the death receptor signal engager comprises an amino acid sequence of SEQ ID NO: 6159, or an amino acid sequence having at least about 75%, 80%, 85%, 90%, 95%, or 99% sequence identity thereto.

221. The multifunctional molecule of any of embodiments 202-217, wherein the death receptor signal engager comprises an amino acid sequence of SEQ ID NO: 6160, or an amino acid sequence having at least about 75%, 80%, 85%, 90%, 95%, or 99% sequence identity thereto.

222. The multifunctional molecule of any of embodiments 202-217, wherein the death receptor signal engager comprises an amino acid sequence of SEQ ID NO: 6161, or an amino acid sequence having at least about 75%, 80%, 85%, 90%, 95%, or 99% sequence identity thereto.

223. The multifunctional molecule of any of embodiments 202-217, wherein the death receptor signal engager comprises an amino acid sequence of SEQ ID NO: 6162, or an amino acid sequence having at least about 75%, 80%, 85%, 90%, 95%, or 99% sequence identity thereto.

224. The multifunctional molecule of any of embodiments 202-217, wherein the death receptor signal engager comprises an amino acid sequence of SEQ ID NO: 6163, or an amino acid sequence having at least about 75%, 80%, 85%, 90%, 95%, or 99% sequence identity thereto.

225. The multifunctional molecule of any of embodiments 202-217, wherein the death receptor signal engager comprises an amino acid sequence of SEQ ID NO: 6164, or an amino acid sequence having at least about 75%, 80%, 85%, 90%, 95%, or 99% sequence identity thereto.

226. The multifunctional molecule of any of embodiments 202-217, wherein the death receptor signal engager comprises an amino acid sequence of SEQ ID NO: 6165, or an amino acid sequence having at least about 75%, 80%, 85%, 90%, 95%, or 99% sequence identity thereto.

227. The multifunctional molecule of embodiment 56, wherein the T cell engager binds to TCRβ, e.g., to TCR beta V chain (TCRBV).

228. The multifunctional molecule of embodiment 227, wherein the T cell engager comprises an antigen binding domain (e.g., an antibody molecule or fragment thereof) that binds to (e.g., and in some embodiments activates) TCRβ.

229. The multifunctional molecule of either of embodiments 227 or 228, wherein the T cell engager comprises an anti-TCRβV antibody molecule, e.g., that specifically binds to a human TCR beta V chain (TCRβV).

230. The multifunctional molecule of any of embodiments 227-229, wherein the T cell engager does not bind to the lymphoma cell or the lymphocyte expressing TRBC1 or TRBC2.

231. The multifunctional molecule of any of embodiments 227-229, wherein the T cell engager is capable of binding to or binds to the lymphoma cell or the lymphocyte expressing TRBC1 or TRBC2.

232. The multifunctional molecule of any of embodiments 227-231, wherein the T cell engager does not activate the lymphoma cell or the lymphocyte expressing TRBC1 or TRBC2.

233. The multifunctional molecule of any of embodiments 227-232, wherein the T cell engager comprises an anti-TCRβV antibody molecule that specifically binds to a TCRβV subfamily or subfamily member of Table 12.

234. The multifunctional molecule of embodiment 233, wherein the anti-TCRβV antibody molecule specifically binds to TCRβ V6, e.g., a TCRβ V6 subfamily comprising:

TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01.

235. The multifunctional molecule of embodiment 234, wherein the anti-TCRβV antibody molecule comprises one or more CDRs, framework regions, or variable heavy and/or light chain regions provided in Table 13 or having at least about 93%, 95%, or 99% sequence identity thereto.

236. The multifunctional molecule of embodiment 233, wherein the anti-TCRβV antibody molecule specifically binds to TCRβ V12, e.g., a TCRβ V12 subfamily comprising: TCRβ V12-4*01, TCRβ V12-3*01 or TCRβ V12-5*01.

237. The multifunctional molecule of embodiment 236, wherein the anti-TCRβV antibody molecule comprises one or more CDRs, framework regions, or variable heavy and/or light chain regions provided in Table 14 or having at least about 93%, 95%, or 99% sequence identity thereto.

238. The multifunctional molecule of any one of embodiments 1-51, wherein the multifunctional molecule comprises a stromal modifying moiety.

239. The multifunctional molecule of embodiment 238, wherein the stromal modifying moiety causes one or more of: decreases the level or production of a stromal or extracellular matrix (ECM) component; decreases tumor fibrosis; increases interstitial tumor transport;
improves tumor perfusion; expands the tumor microvasculature; decreases interstitial fluid pressure (IFP) in a tumor; or decreases or enhances penetration or diffusion of an agent, e.g., a cancer therapeutic or a cellular therapy, into a tumor or tumor vasculature.

240. The multifunctional molecule of embodiment 239, wherein the stromal or ECM component decreased is chosen from a glycosaminoglycan or an extracellular protein, or a combination thereof.

241. The multifunctional molecule of any one of embodiments 1-240, wherein the multifunctional molecule comprises:
(i) an immune cell engager (e.g., a T cell engager, an NK cell engager, a B cell engager, a dendritic cell engager, or a macrophage cell engager) and a cytokine molecule,
(ii) an immune cell engager (e.g., a T cell engager, an NK cell engager, a B cell engager, a dendritic cell engager, or a macrophage cell engager) and a cytokine inhibitor molecule,
(iii) an immune cell engager (e.g., a T cell engager, an NK cell engager, a B cell engager, a dendritic cell engager, or a macrophage cell engager) and a death receptor signal engager,
(iv) an immune cell engager (e.g., a T cell engager, an NK cell engager, a B cell engager, a dendritic cell engager, or a macrophage cell engager) and a stromal modifying moiety,
(v) a cytokine molecule and a stromal modifying moiety,
(vi) a cytokine molecule and a death receptor signal engager,
(vii) a cytokine inhibitor molecule and a stromal modifying moiety,
(viii) a cytokine inhibitor molecule and a death receptor signal engager,
(ix) an immune cell engager (e.g., a T cell engager, an NK cell engager, a B cell engager, a dendritic cell engager, or a macrophage cell engager), a cytokine molecule, a death receptor signal engager, and a stromal modifying moiety, or
(x) an immune cell engager (e.g., a T cell engager, an NK cell engager, a B cell engager, a dendritic cell engager, or a macrophage cell engager), a cytokine inhibitor molecule, a death receptor signal engager, and a stromal modifying moiety.

242. The multifunctional molecule of any one of embodiments 1-241, wherein the multifunctional molecule comprises the following configuration:

A, B-[dimerization module]-C, -D, wherein:

(a) the dimerization module comprises an immunoglobulin constant domain, e.g., a heavy chain constant domain (e.g., a homodimeric or heterodimeric heavy chain constant region, e.g., an Fc region), or a constant domain of an immunoglobulin variable region (e.g., a Fab region); and
(b) A, B, C, and D are independently absent; (i) an antigen binding domain that preferentially binds to TRBC1 or TRBC2; (ii) an immune cell engager chosen from a T cell engager, an NK cell engager, a B cell engager, a dendritic cell engager, or a macrophage cell engager; (iii) a cytokine molecule or cytokine inhibitor molecule; (iv) a death receptor signal engager; or (v) a stromal modifying moiety, provided that:
at least one, two, or three of A, B, C, and D comprises an antigen binding domain that preferentially binds to TRBC1 or TRBC2, and
any of the remaining A, B, C, and D is absent or comprises one of an immune cell engager, a cytokine molecule, a cytokine inhibitor molecule, a death receptor signal engager, or a stromal modifying moiety.

243. The multifunctional molecule of embodiment 242, wherein:
(1) A comprises an antigen binding domain that preferentially binds to a T cell receptor comprising TRBC1 or TRBC2, and B, C, or D comprises an immune cell engager, e.g., a T cell engager, e.g., an anti-TCRβV antibody molecule;
(2) A comprises an antigen binding domain that preferentially binds to TRBC1 or TRBC2, and B, C, or D comprises an immune cell engager, e.g., an NK cell engager, e.g., an anti-NKp30 or anti-NKp46 antibody molecule;
(3) A comprises an antigen binding domain that preferentially binds to TRBC1 or TRBC2, and B, C, or D comprises a cytokine molecule;
(4) A comprises an antigen binding domain that preferentially binds to TRBC1 or TRBC2, and B, C, or D comprises a cytokine inhibitor molecule;
(5) A comprises an antigen binding domain that preferentially binds to TRBC1 or TRBC2, and B, C, or D comprises a death receptor signal engager;
(6) A comprises an antigen binding domain that preferentially binds to TRBC1 or TRBC2, and B, C, or D comprises a stromal modifying moiety;
(7) A comprises a first antigen binding domain that binds to a TRBC1 or TRBC2, B comprises a second antigen binding domain that preferentially binds to TRBC1 or TRBC2, and C or D comprises an immune cell engager, e.g., a T cell engager, e.g., an anti-TCRβV antibody molecule;
(8) A comprises a first antigen binding domain that binds to TRBC1 or TRBC2, B comprises a second antigen binding domain that preferentially binds to TRBC1 or TRBC2, and C or D comprises an immune cell engager, e.g., an NK cell engager, e.g., an anti-NKp30, anti-NKp46, anti-NKG2D, or anti-CD16 antibody molecule;

(9) A comprises a first antigen binding domain that preferentially binds to TRBC1 or TRBC2, B comprises a second antigen binding domain that preferentially binds to TRBC1 or TRBC2, and C or D comprises a cytokine molecule;
(10) A comprises a first antigen binding domain that preferentially binds to TRBC1 or TRBC2, B comprises a second antigen binding domain that preferentially binds to TRBC1 or TRBC2, and C or D comprises a cytokine inhibitor molecule;
(11) A comprises a first antigen binding domain that preferentially binds to TRBC1 or TRBC2, B comprises a second antigen binding domain that preferentially binds to TRBC1 or TRBC2, and C or D comprises a death receptor signal engager;
(12) A comprises a first antigen binding domain that preferentially binds to TRBC1 or TRBC2, B comprises a second antigen binding domain that preferentially binds to TRBC1 or TRBC2, and C or D comprises a stromal modifying moiety;
(13) A comprises a first antigen binding domain that preferentially binds to TRBC1 or TRBC2, C comprises a second antigen binding domain that preferentially binds to TRBC1 or TRBC2, and B or D comprises an immune cell engager, e.g., a T cell engager, e.g., an anti-TCRβV antibody molecule;
(14) A comprises a first antigen binding domain that preferentially binds to TRBC1 or TRBC2, C comprises a second antigen binding domain that preferentially binds to TRBC1 or TRBC2, and B or D comprises an immune cell engager, e.g., an NK cell engager, e.g., an anti-NKp30, anti-NKp46, anti-NKG2D, or anti-CD16 antibody molecule;
(15) A comprises a first antigen binding domain that preferentially binds to TRBC1 or TRBC2, C comprises a second antigen binding domain that preferentially binds to TRBC1 or TRBC2, and B or D comprises a cytokine molecule;
(16) A comprises a first antigen binding domain that preferentially binds to TRBC1 or TRBC2, C comprises a second antigen binding domain that preferentially binds to TRBC1 or TRBC2, and B or D comprises a cytokine inhibitor molecule;
(17) A comprises a first antigen binding domain that preferentially binds to TRBC1 or TRBC2, C comprises a second antigen binding domain that preferentially binds to TRBC1 or TRBC2, and B or D comprises a death receptor signal engager;
(18) A comprises a first antigen binding domain that preferentially binds to TRBC1 or TRBC2, C comprises a second antigen binding domain that preferentially binds to TRBC1 or TRBC2, and B or D comprises a stromal modifying moiety;
(19) A comprises a first antigen binding domain that preferentially binds to TRBC1 or TRBC2, and B, C, or D comprises (a) an immune cell engager, e.g., an NK cell engager, e.g., an anti-NKp30, anti-NKp46, anti-NKG2D, or anti-CD16 antibody molecule, and (b) a cytokine molecule;
(20) A comprises a first antigen binding domain that preferentially binds to TRBC1 or TRBC2, and B, C, or D comprises (a) an immune cell engager, e.g., an NK cell engager, e.g., an anti-NKp30, anti-NKp46, anti-NKG2D, or anti-CD16 antibody molecule, and (b) a cytokine inhibitor molecule;
(21) A comprises a first antigen binding domain that preferentially binds to TRBC1 or TRBC2, and B, C, or D comprises (a) an immune cell engager, e.g., an NK cell engager, e.g., an anti-NKp30, anti-NKp46, anti-NKG2D, or anti-CD16 antibody molecule, and (b) a death receptor signal engager;
(22) A comprises a first antigen binding domain that preferentially binds to TRBC1 or TRBC2, and B, C, or D comprises (a) an immune cell engager, e.g., an NK cell engager, e.g., an anti-NKp30, anti-NKp46, anti-NKG2D, or anti-CD16 antibody molecule, and (b) a stromal modifying moiety;
(23) A comprises a first antigen binding domain that preferentially binds to TRBC1 or TRBC2, and B, C, or D comprises (a) an immune cell engager, e.g., a T cell engager, e.g., an anti-TCRβV antibody molecule, and (b) a cytokine molecule;
(24) A comprises a first antigen binding domain that preferentially binds to TRBC1 or TRBC2, and B, C, or D comprises (a) an immune cell engager, e.g., a T cell engager, e.g., an anti-TCRβV antibody molecule, and (b) a cytokine inhibitor molecule;
(25) A comprises a first antigen binding domain that preferentially binds to TRBC1 or TRBC2, and B, C, or D comprises (a) an immune cell engager, e.g., a T cell engager, e.g., an anti-TCRβV antibody molecule, and (b) a death receptor signal engager;
(26) A comprises a first antigen binding domain that preferentially binds to TRBC1 or TRBC2, and B, C, or D comprises (a) an immune cell engager, e.g., a T cell engager, e.g., an anti-TCRβV antibody molecule, and (b) a stromal modifying moiety;
(27) A comprises a first antigen binding domain that preferentially binds to TRBC1 or TRBC2, and B, C, or D comprises (a) a cytokine molecule and (b) a stromal modifying moiety;
(28) A comprises a first antigen binding domain that preferentially binds to TRBC1 or TRBC2, and B, C, or D comprises (a) a cytokine molecule and (b) a death receptor signal engager;
(29) A comprises a first antigen binding domain that preferentially binds to TRBC1 or TRBC2, and B, C, or D comprises (a) a cytokine inhibitor molecule and (b) a stromal modifying moiety;
(30) A comprises a first antigen binding domain that preferentially binds to TRBC1 or TRBC2, and B, C, or D comprises (a) a cytokine inhibitor molecule and (b) a death receptor signal engager;
(31) A comprises a first antigen binding domain that preferentially binds to TRBC1 or TRBC2, and B, C, or D comprises (a) a death receptor signal engager and (b) a stromal modifying moiety;
(32) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., an NK cell engager, e.g., an anti-NKp30, anti-NKp46, anti-NKG2D, or anti-CD16 antibody molecule, and (b) a cytokine molecule;
(33) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., an NK cell engager, e.g., an anti-NKp30, anti-NKp46, anti-NKG2D, or anti-CD16 antibody molecule, and (b) a cytokine inhibitor molecule;
(34) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., an NK cell engager, e.g., an anti-NKp30, anti-NKp46, anti-NKG2D, or anti-CD16 antibody molecule, and (b) a death receptor signal engager;

(35) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., an NK cell engager, e.g., an anti-NKp30, anti-NKp46, anti-NKG2D, or anti-CD16 antibody molecule, and (b) a stromal modifying moiety;

(36) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., a T cell engager, e.g., an anti-TCRβV antibody molecule, and (b) a cytokine molecule;

(37) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., a T cell engager, e.g., an anti-TCRβV antibody molecule, and (b) a cytokine inhibitor molecule;

(38) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., a T cell engager, e.g., an anti-TCRβV antibody molecule, and (b) a death receptor signal engager;

(39) A comprises a first antigen binding domain that preferentially binds to TRBC1 or TRBC2, B comprises a second antigen binding domain that preferentially binds to TRBC1 or TRBC2, and C or D comprises (a) an immune cell engager, e.g., a T cell engager, e.g., an anti-TCRβV antibody molecule, and (b) a stromal modifying moiety;

(40) A comprises a first antigen binding domain that preferentially binds to TRBC1 or TRBC2, B comprises a second antigen binding domain that preferentially binds to TRBC1 or TRBC2, and C or D comprises (a) a cytokine molecule and (b) a stromal modifying moiety;

(41) A comprises a first antigen binding domain that preferentially binds to TRBC1 or TRBC2, B comprises a second antigen binding domain that preferentially binds to TRBC1 or TRBC2, and C or D comprises (a) a cytokine molecule and (b) a death receptor signal engager;

(42) A comprises a first antigen binding domain that preferentially binds to TRBC1 or TRBC2, B comprises a second antigen binding domain that preferentially binds to TRBC1 or TRBC2, and C or D comprises (a) a cytokine inhibitor molecule and (b) a stromal modifying moiety;

(43) A comprises a first antigen binding domain that preferentially binds to TRBC1 or TRBC2, B comprises a second antigen binding domain that preferentially binds to TRBC1 or TRBC2, and C or D comprises (a) a cytokine inhibitor molecule and (b) a death receptor signal engager;

(44) A comprises a first antigen binding domain that preferentially binds to TRBC1 or TRBC2, B comprises a second antigen binding domain that preferentially binds to TRBC1 or TRBC2, and C or D comprises (a) a stromal modifying moiety and (b) a death receptor signal engager;

(45) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., an NK cell engager, e.g., an anti-NKp30, anti-NKp46, anti-NKG2D, or anti-CD16 antibody molecule, and (b) a cytokine molecule;

(46) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., an NK cell engager, e.g., an anti-NKp30, anti-NKp46, anti-NKG2D, or anti-CD16 antibody molecule, and (b) a cytokine inhibitor molecule;

(47) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., an NK cell engager, e.g., an anti-NKp30, anti-NKp46, anti-NKG2D, or anti-CD16 antibody molecule, and (b) a death receptor signal engager;

(48) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., an NK cell engager, e.g., an anti-NKp30, anti-NKp46, anti-NKG2D, or anti-CD16 antibody molecule, and (b) a stromal modifying moiety;

(49) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., a T cell engager, e.g., an anti-TCRβV antibody molecule, and (b) a cytokine molecule;

(50) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., a T cell engager, e.g., an anti-TCRβV antibody molecule, and (b) a cytokine inhibitor molecule;

(51) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., a T cell engager, e.g., an anti-TCRβV antibody molecule, and (b) a death receptor signal engager;

(52) A comprises a first antigen binding domain that preferentially binds to TRBC1 or TRBC2, C comprises a second antigen binding domain that preferentially binds to TRBC1 or TRBC2, and B or D comprises (a) an immune cell engager, e.g., a T cell engager, e.g., an anti-TCRβV antibody molecule, and (b) a stromal modifying moiety;

(53) A comprises a first antigen binding domain that preferentially binds to TRBC1 or TRBC2, C comprises a second antigen binding domain that preferentially binds to TRBC1 or TRBC2, and B or D comprises (a) a cytokine molecule and (b) a stromal modifying moiety;

(54) A comprises a first antigen binding domain that preferentially binds to TRBC1 or TRBC2, C comprises a second antigen binding domain that preferentially binds to TRBC1 or TRBC2, and B or D comprises (a) a cytokine molecule and (b) a death receptor signal engager;

(55) A comprises a first antigen binding domain that preferentially binds to TRBC1 or TRBC2, C comprises a second antigen binding domain that preferentially binds to TRBC1 or TRBC2, and B or D comprises (a) a cytokine inhibitor molecule and (b) a stromal modifying moiety;

(56) A comprises a first antigen binding domain that preferentially binds to TRBC1 or TRBC2, C comprises a second antigen binding domain that preferentially binds to TRBC1 or TRBC2, and B or D comprises (a) a cytokine inhibitor molecule and (b) a death receptor signal engager;

or

(57) A comprises a first antigen binding domain that preferentially binds to TRBC1 or TRBC2, C comprises a second antigen binding domain that preferentially binds to TRBC1 or TRBC2, and B or D comprises (a) a stromal modifying moiety and (b) a death receptor signal engager.

244. The multifunctional molecule of embodiment 242 or 243, wherein the dimerization module comprises one or more immunoglobulin chain constant regions (e.g., Fc regions) comprising one or more of: a paired cavity-protuberance ("knob-in-a hole"), an electrostatic interaction, or a strand-exchange.

245. The multifunctional molecule of embodiment 244, wherein the one or more immunoglobulin chain constant regions (e.g., Fc regions) comprise an amino acid substitution at a position chosen from one or more of 347, 349, 350, 351, 366, 368, 370, 392, 394, 395, 397, 398, 399, 405, 407, or 409, e.g., of the Fc region of human IgG1, optionally wherein the one or more immunoglobulin chain constant regions (e.g., Fc regions) comprise an amino acid substitution chosen from: T366S, L368A, or Y407V (e.g., corresponding to a cavity or hole), or T366W (e.g., corresponding to a protuberance or knob), or a combination thereof.

246. The multifunctional molecule of any one of embodiments 1-245, further comprising a linker, e.g., a linker between one or more of: the antigen binding domain and the immune cell engager, the antigen binding domain and the cytokine molecule, the antigen binding domain and the stromal modifying moiety, the immune cell engager and the cytokine molecule, the immune cell engager and the stromal modifying moiety, the cytokine molecule and the stromal modifying moiety, the antigen binding domain and the dimerization module, the immune cell engager and the dimerization module, the cytokine molecule and the dimerization module, or the stromal modifying moiety and the dimerization module.

247. The multifunctional molecule of embodiment 246, wherein the linker is chosen from: a cleavable linker, a non-cleavable linker, a peptide linker, a flexible linker, a rigid linker, a helical linker, or a non-helical linker.

248. The multifunctional molecule of embodiment 246 or 247, wherein the linker is a peptide linker.

249. The multifunctional molecule of 248, wherein the peptide linker comprises Gly and Ser.

250. The multifunctional molecule of 249, wherein the peptide linker comprises an amino acid sequence chosen from SEQ ID NOs: 7249-7252 or 75-78.

251. A multifunctional molecule, comprising:
(i) a first antigen binding domain that preferentially binds to TRBC1, and
(ii) an NK cell engager, e.g., an anti-NKp30 antibody molecule, anti-NKp46 antibody molecule, an anti-NKG2D antibody molecule, or an anti-CD16 antibody molecule.

252. The multifunctional molecule of embodiment 251, wherein the NK cell engager comprises an anti-NKp30 antibody molecule.

254. The multifunctional molecule of embodiment 251, wherein the NK cell engager comprises an anti-NKp46 antibody molecule.

255. The multifunctional molecule of claim 251, wherein the NK cell engager comprises an anti-NKG2D antibody molecule.

255A. The multifunctional molecule of claim 251, wherein the NK cell engager comprises an anti-CD16 antibody molecule.

256. A multifunctional molecule, comprising:
(i) a first antigen binding domain that preferentially binds to TRBC1, and
(ii) a death receptor signal engager.

257. A multifunctional molecule, comprising:
(i) a first antigen binding domain that preferentially binds to TRBC1, and
(ii) a T cell engager, e.g., an antigen binding domain that binds to TCR beta V chain (TCRBV).

259. A multifunctional molecule, comprising:
(i) a first antigen binding domain that preferentially binds to TRBC1, and
(ii) a cytokine inhibitor molecule, e.g., TGF-beta inhibitor.

262. The multifunctional molecule of any of embodiments 1 or 3-261, wherein the multifunctional molecule binds to TRBC1, TRBC2, or the tumor antigen monovalently.

263. The multifunctional molecule of any one of embodiments 1 or 3-261, wherein the multifunctional molecule binds to TRBC1, TRBC2, or the tumor antigen multivalently, e.g., di-, tri-, tetra-, penta-, hexa-, hepta-, octa-, nona-, or deca-valently.

264. The multifunctional molecule of any of embodiments 2-261, wherein the multifunctional molecule binds to TRBC1, TRBC2, or the lymphocyte expressing TRBC1 or TRBC2 monovalently.

265. The multifunctional molecule of any one of embodiments 2-261, wherein the multifunctional molecule binds to the lymphocyte expressing TRBC1 or TRBC2 multivalently, e.g., di-, tri-, tetra-, penta-, hexa-, hepta-, octa-, nona-, or deca-valently.

266. The multifunctional molecule of any preceding embodiment, wherein the multifunctional molecule binds, e.g., via the immune cell engager, to the immune cell monovalently.

267. The multifunctional molecule of any one of embodiments 1-265, wherein the multifunctional molecule binds, e.g., via the immune cell engager, to the immune cell multivalently, e.g., di-, tri-, tetra-, penta-, hexa-, hepta-, octa-, nona-, or deca-valently.

268. The multifunctional molecule of any preceding embodiment, further comprising a heavy chain constant region, e.g., an Fc region, that mediates antibody dependent cellular cytotoxicity (ADCC).

268A. The multifunctional molecule of any preceding embodiment, further comprising a heavy chain constant region, e.g., an Fc region, that mediates antibody dependent cellular phagocytosis (ADCP).

268B. The multifunctional molecule of embodiment 268A, wherein the first antigen binding domain that binds TRBC1 or TRBC2 comprises an IgG2 heavy chain constant region or the immune cell engager, cytokine inhibitor molecule, or death receptor signal engager comprise an IgG2 heavy chain constant region.

269. The multifunctional molecule of any preceding embodiment, further comprising a heavy chain constant region, e.g., an Fc region, that mediates complement dependent cytotoxicity (e.g., via C1q).

269A. An antibody molecule that binds TRBC1, comprising one or more CDRs, framework regions, variable domains, heavy or light chains, or an antigen binding domain chosen from Tables 2-5, or a sequence substantially identical thereto.

269B. The antibody molecule of embodiment 269A, comprising a heavy chain variable region (VH) comprising a heavy chain framework region 1 (VHFWR1) amino acid sequence of SEQ ID NO: 215 (or a sequence with no more than 1, 2, 3, 4, 5, or 6 mutations, e.g., substitutions, additions, or deletions, therefrom), a VHFWR2 amino acid sequence of SEQ ID NO: 216 (or a sequence with no more than 1, 2, 3, 4, 5, or 6 mutations, e.g., substitutions, additions, or deletions, therefrom), a VHFWR3 amino acid sequence of SEQ ID NO: 217 (or a sequence with no more than 1, 2, 3, 4, 5, or 6 mutations, e.g., substitutions, additions, or deletions, therefrom), or a VHFWR4 amino acid sequence of SEQ ID NO: 218 (or a sequence with no more than 1, 2, 3, 4, 5, or 6 mutations, e.g., substitutions, additions, or deletions, therefrom).

269C. The antibody molecule of either of embodiments 269A or 269B, comprising a light chain variable region (VL) comprising a light chain framework region 1 (VLFWR1) amino acid sequence of SEQ ID NO: 238 (or a sequence with no more than 1, 2, 3, 4, 5, or 6 mutations, e.g., substitutions, additions, or deletions, therefrom), a VLFWR2 amino acid sequence of SEQ ID NO: 239 (or a sequence with no more than 1, 2, 3, 4, 5, or 6 mutations, e.g., substitutions, additions, or deletions, therefrom), a VLFWR3 amino acid sequence of SEQ ID NO: 240 (or a sequence with no more than 1, 2, 3, 4, 5, or 6 mutations, e.g., substitutions, additions, or deletions, therefrom), or a VLFWR4 amino acid sequence of SEQ ID NO: 241 (or a sequence with no more than 1, 2, 3, 4, 5, or 6 mutations, e.g., substitutions, additions, or deletions, therefrom).

269D. The antibody molecule of any of embodiments 269A-269C, wherein the antibody molecule comprises a VH comprising the amino acid sequence of SEQ ID NO: 253 (or an amino acid sequence having at least about 75%, 80%, 85%, 90%, 95%, or 99% sequence identity thereto).

269E. The antibody molecule of any of embodiments 269A-269D, wherein the antibody molecule comprises a VL comprising the amino acid sequence of SEQ ID NO: 258 (or an amino acid sequence having at least about 93%, 95%, or 99% sequence identity thereto).

270. A nucleic acid molecule encoding the multifunctional molecule or antibody molecule of any one of embodiments 1-269E.

271. A vector, e.g., an expression vector, comprising the nucleic acid molecules of embodiment 270.

272. A host cell comprising the nucleic acid molecule of embodiment 270 or the vector of embodiment 271.

273. A method of making, e.g., producing, the multifunctional molecule or antibody molecule of any one of embodiments 1-269E, comprising culturing the host cell of embodiment 272, under suitable conditions, e.g., conditions suitable for gene expression and/or homo- or heterodimerization.

274. A pharmaceutical composition comprising the multifunctional molecule of any one of embodiments 1-269 and a pharmaceutically acceptable carrier, excipient, or stabilizer.

275. A method of treating a cancer, comprising administering to a subject in need thereof the multifunctional molecule of any one of embodiments 1-269, wherein the multifunctional molecule is administered in an amount effective to treat the cancer.

276. The method of embodiment 275, further comprising identifying, evaluating, or selecting a subject in need of treatment, wherein identifying, evaluating, or selecting comprises determining (e.g., directly determining or indirectly determining, e.g., obtaining information regarding) whether a subject has cancer cells that express a T cell receptor comprising TRBC1 or TRBC2.

277. The method of embodiment 276, further comprising, responsive to determining that a subject has cancer cells that express a T cell receptor comprising TRBC1:
optionally, selecting the subject for treatment with a multifunctional molecule comprising an antigen binding domain that binds to a T cell receptor comprising TRBC1, and
administering a multifunctional molecule comprising an antigen binding domain that binds to a T cell receptor comprising TRBC1.

278. The method of embodiment 277, further comprising not administering a multifunctional molecule comprising an antigen binding domain that binds to a T cell receptor comprising TRBC2.

278A. A method of treating a cancer, e.g., a lymphoma or leukemia, comprising: responsive to determining that a subject has cancer cells that express a T cell receptor comprising TRBC1, administering to a subject in need thereof the multifunctional molecule of any one of claims 1-269, wherein the multifunctional molecule is administered in an amount effective to treat the cancer.

279. The method of embodiment 276, further comprising, responsive to determining that a subject has cancer cells that express a T cell receptor comprising TRBC2:
optionally, selecting the subject for treatment with a multifunctional molecule comprising an antigen binding domain that binds to a T cell receptor comprising TRBC2, and
administering a multifunctional molecule comprising an antigen binding domain that binds to a T cell receptor comprising TRBC2.

280. The method of embodiment 279, further comprising not administering a multifunctional molecule comprising an antigen binding domain that binds to a T cell receptor comprising TRBC1.

281. The method of any of embodiments 275-278, wherein the subject has cancer cells that express a T cell receptor comprising TRBC1.

282. The method of any of embodiments 275, 276, 279, or 280, wherein the subject has cancer cells that express a T cell receptor comprising TRBC2.

283. A method of identifying a subject in need of treatment for cancer using a multifunctional molecule or antibody molecule of any of embodiments 1-269E, comprising determining (e.g., directly determining or indirectly determining, e.g., obtaining information regarding) whether a subject has cancer cells that express a T cell receptor comprising TRBC1 or TRBC2, wherein:
  responsive to determining that the subject has cancer cells that express a T cell receptor comprising TRBC1, identifying the subject as a candidate for treatment using a multifunctional molecule comprising an antigen binding domain that binds to TRBC1, and optionally not as a candidate for treatment using a multifunctional molecule comprising an antigen binding domain that binds to TRBC2, and
  responsive to determining that the subject has cancer cells that express a T cell receptor comprising TRBC2, identifying the subject as a candidate for treatment using a multifunctional molecule comprising an antigen binding domain that binds to TRBC2, and optionally not as a candidate for treatment using a multifunctional molecule comprising an antigen binding domain that binds to TRBC1.

284. The method of embodiment 283, further comprising:
  responsive to identifying the subject as a candidate for treatment using a multifunctional molecule comprising an antigen binding domain that binds to TRBC1, treating the subject with (e.g., administering to the subject) a multifunctional molecule comprising an antigen binding domain that binds to TRBC1, or
  responsive to identifying the subject as a candidate for treatment using a multifunctional molecule comprising an antigen binding domain that binds to TRBC2, treating the subject with (e.g., administering to the subject) a multifunctional molecule comprising an antigen binding domain that binds to TRBC2.

285. A method of evaluating a subject in need of treatment for cancer, e.g., a lymphoma, comprising determining (e.g., directly determining or indirectly determining, e.g., obtaining information regarding) whether a subject has cancer cells that express a T cell receptor comprising TRBC1 or TRBC2.

286. The method of embodiment 285, further comprising responsive to the evaluation, treating the subject with (e.g., administering to the subject) a multifunctional molecule comprising an antigen binding domain that binds to TRBC1 or a multifunctional molecule comprising an antigen binding domain that binds to TRBC2.

287. The method of any one of embodiments 275-286, wherein the cancer is a hematological cancer.

288. The method of embodiment 287, wherein the hematological cancer is leukemia or lymphoma.

289. The method of embodiment 288, wherein the hematological cancer is selected from leukemia (e.g., acute lymphoblastic leukemia (ALL), acute myeloid leukemia (AML), chronic lymphocytic leukemia (CLL), chronic myelogenous leukemia (CML), hairy cell leukemia, acute monocytic leukemia (AMoL), chronic myelomonocytic leukemia (CMML), juvenile myelomonocytic leukemia (JMML), or large granular lymphocytic leukemia), lymphoma (e.g., AIDS-related lymphoma, cutaneous T-cell lymphoma, Hodgkin lymphoma (e.g., classical Hodgkin lymphoma or nodular lymphocyte-predominant Hodgkin lymphoma), mycosis fungoides, non-Hodgkin lymphoma (e.g., B-cell non-Hodgkin lymphoma (e.g., Burkitt lymphoma, small lymphocytic lymphoma (CLL/SLL), diffuse large B-cell lymphoma, follicular lymphoma, immunoblastic large cell lymphoma, precursor B-lymphoblastic lymphoma, or mantle cell lymphoma) or T-cell non-Hodgkin lymphoma (mycosis fungoides, anaplastic large cell lymphoma, or precursor T-lymphoblastic lymphoma)), primary central nervous system lymphoma, Sezary syndrome, Waldenstrom macroglobulinemia), chronic myeloproliferative neoplasm, Langerhans cell histiocytosis, multiple myeloma/plasma cell neoplasm, myelodysplastic syndrome, or myelodysplastic/myeloproliferative neoplasm.

290. The method of embodiment 288, wherein the lymphoma is selected from Acquired immune deficiency syndrome (AIDS)-associated lymphoma, Angioimmunoblastic T-cell lymphoma, Adult T-cell leukemia/lymphoma, Burkitt T-cell lymphoma, Central nervous system (CNS) lymphoma, Diffuse large B-cell lymphoma (DLBCL), Lymphoblastic lymphoma, Mantle cell lymphoma (MCL), Peripheral T-cell lymphoma (PTCL) (e.g., Hepatosplenic T-cell lymphoma (HSGDTCL), Subcutaneous paniculitis-like T-cell lymphoma, or Enteropathy-associated T-cell lymphoma), Transformed follicular and transformed mucosa-associated lymphoid tissue (MALT) lymphomas, Cutaneous T-cell lymphoma (mycosis fungoides and Sezary syndrome), Follicular lymphoma, Lymphoplasmacytic lymphoma/Waldenstrom macroglobulinemia, Marginal zone B-cell lymphoma, Gastric mucosa-associated lymphoid tissue (MALT) lymphoma, Chronic lymphocytic leukemia/small-cell lymphocytic lymphoma (CLL/SLL), Extranodal T-/NK-cell lymphoma (nasal type), or Anaplastic large-cell lymphoma (e.g., primary cutaneous anaplastic large-cell lymphoma or systemic anaplastic large-cell lymphoma).

291. The method of any one of embodiments 275-286, the cancer is a solid tumor cancer.

292. The method of any of embodiments 275-291, further comprising administering a second therapeutic treatment.

293. The method of embodiment 292, wherein the second therapeutic treatment comprises a therapeutic agent (e.g., a chemotherapeutic agent, a biologic agent, hormonal therapy), radiation, or surgery.

294. The method of embodiment 293, wherein the therapeutic agent is selected from: a chemotherapeutic agent, or a biologic agent.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods, and examples are illustrative only and are not intended to be limiting.

Other features and advantages of the invention will be apparent from the following detailed description and claims.

BRIEF DESCRIPTION OF THE DRAWINGS

FIGS. 1A-1D are schematic representations of exemplary formats and configurations of multispecific antibodies (e.g., bispecific antibodies) that bind to TRBC1 and NKp30. FIG. 1A depicts an anti-TRBC1 antibody fused to an anti-NKp30 scFv. The anti-TRBC1 antibody comprises two heavy chains and two light chains. The anti-NKp30 scFv is fused to the N-terminus of one heavy chain of the anti-TRBC1 antibody. FIG. 1B depicts an antibody molecule comprising an anti-TRBC1 Fab, an anti-NKp30 scFv, and an Fc dimer. The Fc dimer comprises two Fc chains. The C-terminus of the heavy chain of the anti-TRBC1 Fab is fused to the N-terminus of one Fc chain. The anti-NKp30 scFv is fused to the N-terminus of the other Fc chain. FIGS. 1C and 1D depict an anti-TRBC1 antibody fused to two anti-NKp30 scFvs. The anti-TRBC1 antibody comprises two heavy chains and two light chains. In FIG. 1C, the two anti-NKp30 scFvs are fused to the C-terminus of the two light chains of the anti-TRBC1 antibody, respectively. In FIG. 1D, the two anti-NKp30 scFvs are fused to the N-terminus of the two heavy chains of the anti-TRBC1 antibody, respectively.

FIGS. 2A and 2D depict an antibody molecule comprising an anti-TRBC1 Fab, a trimeric TRAIL molecule, and an Fc dimer. FIGS. 2B and 2E depict an antibody molecule comprising an anti-TRBC1 Fab, a dimeric TRAIL molecule, and an Fc dimer. FIGS. 2C and 2F depict an antibody molecule comprising an anti-TRBC1 Fab, a monomeric TRAIL molecule, and an Fc dimer. The Fc dimer comprises two Fc chains. The C-terminus of the heavy chain of the anti-TRBC1 Fab is fused to the N-terminus of one Fc chain. The trimeric, dimeric, or monomeric TRAIL molecule is fused to the N-terminus of the other Fc chain. In some embodiments, the antibody molecule depicted in FIG. 2A comprises the amino acid sequences of SEQ ID NOs: 6169, 6167, and 6159. In some embodiments, the antibody molecule depicted in FIG. 2B comprises the amino acid sequences of SEQ ID NOs: 6169, 6167, and 6158. In some embodiments, the antibody molecule depicted in FIG. 2C comprises the amino acid sequences of SEQ ID NOs: 6169, 6167, and 6157. In some embodiments, then antibody molecule depicted in FIG. 2D comprises the amino acid sequences of SEQ ID NOs: 6169, 6167, and 6162. In some embodiments, then antibody molecule depicted in FIG. 2E comprises the amino acid sequences of SEQ ID NOs: 6169, 6167, and 6161. In some embodiments, then antibody molecule depicted in FIG. 2F comprises the amino acid sequences of SEQ ID NOs: 6169, 6167, and 6160.

FIGS. 3A and 3B are schematic representations of exemplary formats and configurations of multispecific antibodies (e.g., bispecific antibodies) that bind to TRBC1 and DR5. FIG. 3A depicts a multispecific antibody (e.g., a bispecific antibody) comprising an anti-TRBC1 Fab, an anti-DR5 scFv, and an Fc dimer. The Fc dimer comprises two Fc chains. The C-terminus of the heavy chain of the anti-TRBC1 Fab is fused to the N-terminus of one Fc chain. The anti-DR5 scFv is fused to the N-terminus of the other Fc chain. FIG. 3B depicts an anti-TRBC1 antibody fused to two anti-DR5 scFvs. The anti-TRBC1 antibody comprises two heavy chains and two light chains. The two anti-DR5 scFvs are fused to the C-terminus of the two light chains of the anti-TRBC1 antibody, respectively. In some embodiments, the multispecific antibody depicted in FIG. 3A comprises the amino acid sequences of SEQ ID NOs: 6169, 6167, and 6163. In some embodiments, the multispecific antibody depicted in FIG. 3B comprises the amino acid sequences of SEQ ID NOs: 6170 and 6168.

FIGS. 4A-4B shows the alignment of the H131 source mouse VH and VL framework 1, CDR 1, framework 2, CDR 2, framework 3, CDR3, and framework 4 regions with their respective humanized sequences. Kabat CDRs are shown in bold, Chothia CDRs are shown in italics, and combined CDRs are shown in boxes. The framework positions that were back mutated are double underlined. FIG. 4A shows VH sequences for murine H131 (SEQ ID NO: 1) and humanized H131 (SEQ ID NO: 9). FIG. 4B shows VL sequences for murine H131 (SEQ ID NO: 2) and humanized H131 (SEQ ID NO: 10 and SEQ ID NO: 11).

FIGS. 5A-5B shows the alignment of the 16G8 source mouse VH and VL framework 1, CDR 1, framework 2, CDR 2, framework 3, CDR3, and framework 4 regions with their respective humanized sequences. Kabat CDRs are shown in bold, Chothia CDRs are shown in italics, and combined CDRs are shown in boxes. The framework positions that were back mutated are double underlined. FIG. 5A shows VH sequences for murine 16G8 (SEQ ID NO: 15) and humanized 16G8 (SEQ ID NOs: 23-25). FIG. 5B shows VL sequences for murine 16G8 (SEQ ID NO: 16) and humanized 16G8 (SEQ ID NOs: 26-30).

FIGS. 11A-11E are schematic representations of anti-TRBC1/NKp30 antibodies and control molecules.

FIGS. 13A-13D are graphs showing T cell activation after incubation with the indicated antibodies. FIG. 13A is a graph showing % CD4+ divided. FIG. 13B is a graph showing % CD8+ divided. FIG. 13C is a graph showing % CD69-CD25+ of CD4+. FIG. 13D is a graph showing % CD69-CD25+ of CD8+.

In FIGS. 14B and 14D, "460" indicates a Fab based on BIM0460; "578" indicates a Fab based on BJM0578; "407" indicates a scFv (FIG. 18B) or a Fab (FIG. 14D) based on BJM0407; "411" indicates a scFv (FIG. 18B) or a Fab (FIG. 14D) based on BJM0411; and "N297A" indicates that the antibody comprises an N297A mutation in the Fc region.

FIGS. 15A-15D are graphs showing binding of the indicated antibodies to NK cell line KHYG-1 (FIG. 15A) and TRBC1+ Jurkat cells (FIG. 15B). FIG. 15C is a table providing information on the antibodies tested. FIG. 15D is a table providing EC50 for binding to KHYG-1 cells or TRBC1+ Jurkat cells.

FIGS. 16A-16C are graphs showing killing of TRBC1+ target cells in the presence of NK-92 effector cells. The target cells are TRBC1+ Jurkat cells (FIG. 16A) or H9 cells (FIG. 16B). TRBC2+ HPB-ALL cells were used as a control (FIG. 16C).

FIGS. 17A-17C are graphs showing killing of TRBC1+ target cells in the presence of primary NK cells. The target cells are TRBC1+ Jurkat cells (FIG. 17A) or H9 cells (FIG. 17B). TRBC2+ HPB-ALL cells were used as a control (FIG. 17C).

FIG. 18A shows % CD69+CD107a+ NK cells. FIG. 18B shows the level of IFNγ. FIG. 18C shows the level of TNFα.

FIG. 19A shows the level of IFNγ. FIG. 19B shows the level of TNFα.

FIGS. 22A-22D are graphs showing NK cell-mediated killing of TRBC1+ PDX in the presence of the indicated antibodies.

FIG. 26A shows binding of B7-H6 to NKp30. FIG. 26B shows binding of BJM1042 to NKp30. FIG. 26C shows binding of B7-H6 to NKp30 in the presence of varying concentrations of the indicated antibodies.

FIG. 27A shows the study design. FIG. 27B shows tumor volume under the indicated treatments. FIG. 27C is a water plot showing % change in tumor volume on Day 3 post treatment. The following treatment groups are shown in FIG. 27C from left to right: No NK, PBS; No NK, TRBC1×NKp30; NK, PBS; NK, TRBC1; NK, NKp30; and NK+1mpk BJM1042.

FIG. 28A shows the study design. FIG. 28B shows tumor volume under the indicated treatments.

DETAILED DESCRIPTION OF THE INVENTION

Figures 1C, 1D:
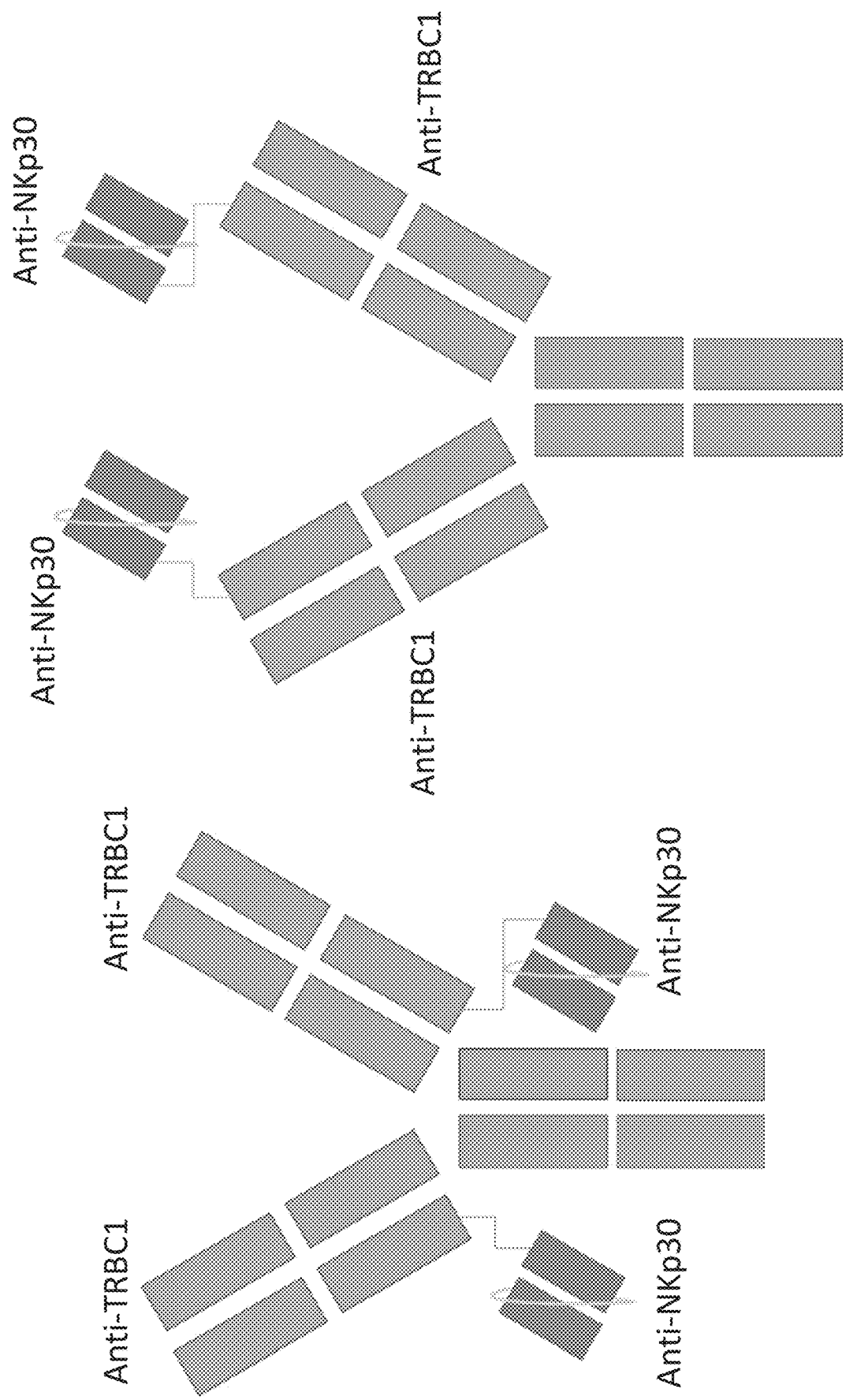
Figure 2B:
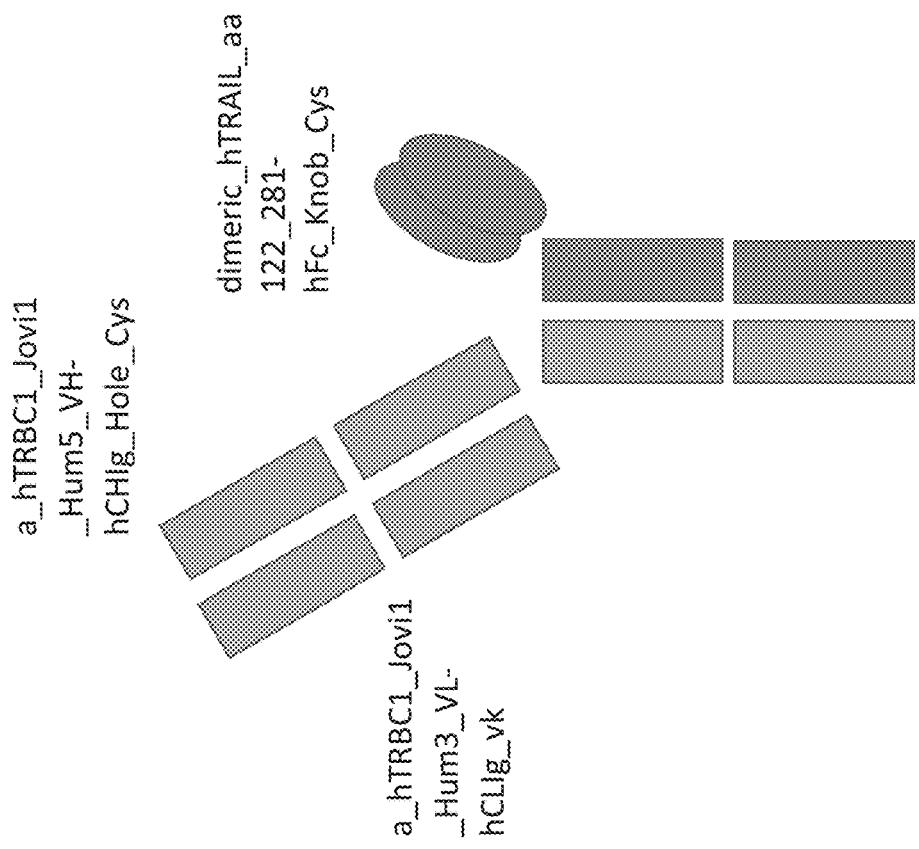
FIGS. 2A-2F are schematic representations of exemplary formats and configurations of antibody molecules that comprises a moiety that binds to TRBC1 and a TRAIL molecule (e.g., a trimeric, dimeric, or monomeric TRAIL molecule).
Figure 2A:
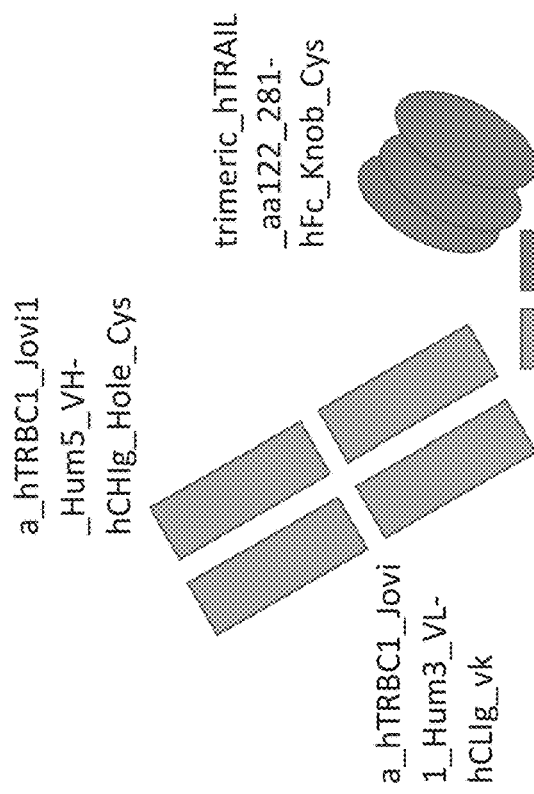
Figures 2C, 2D:
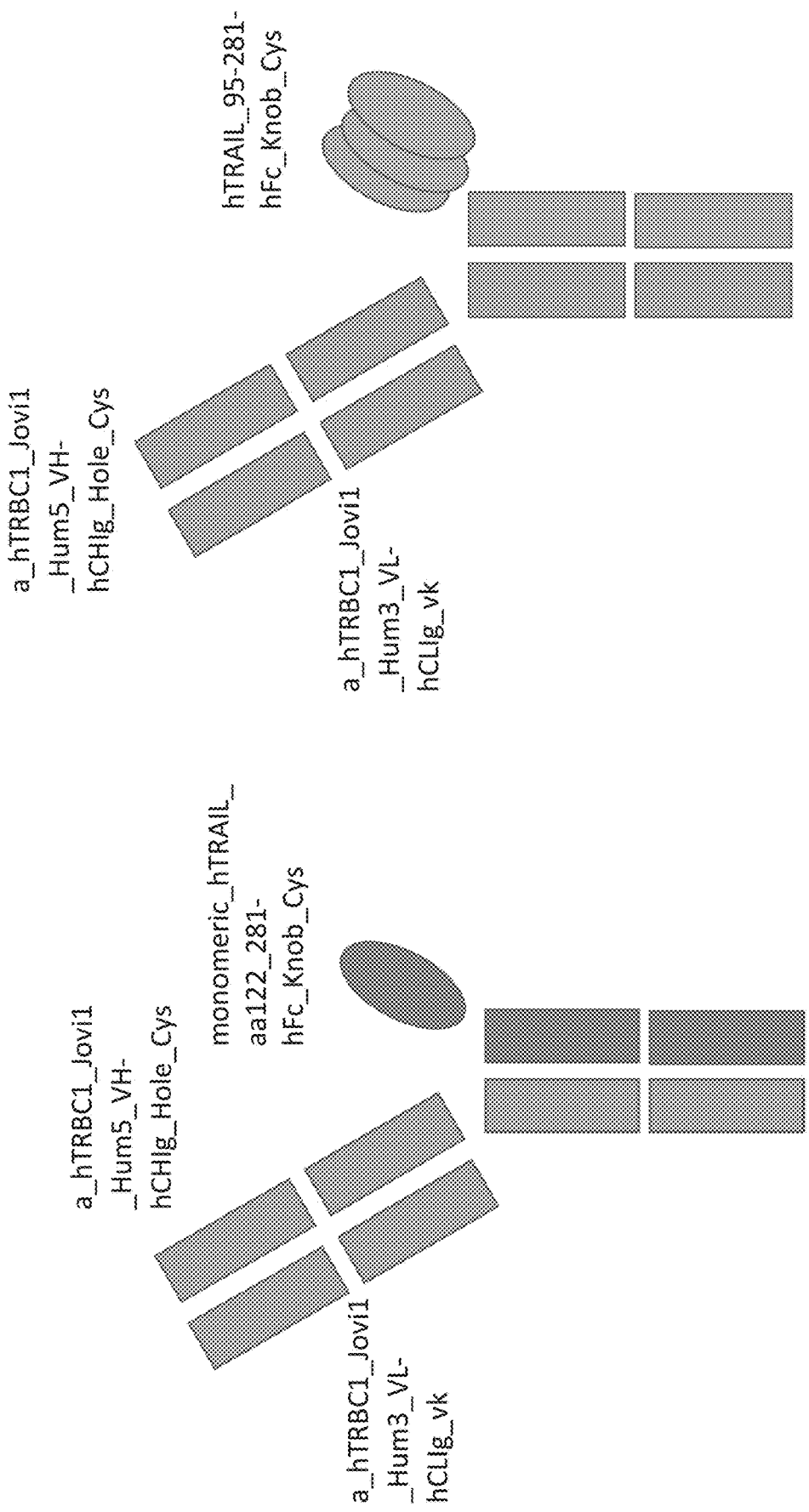
Figure 2E:
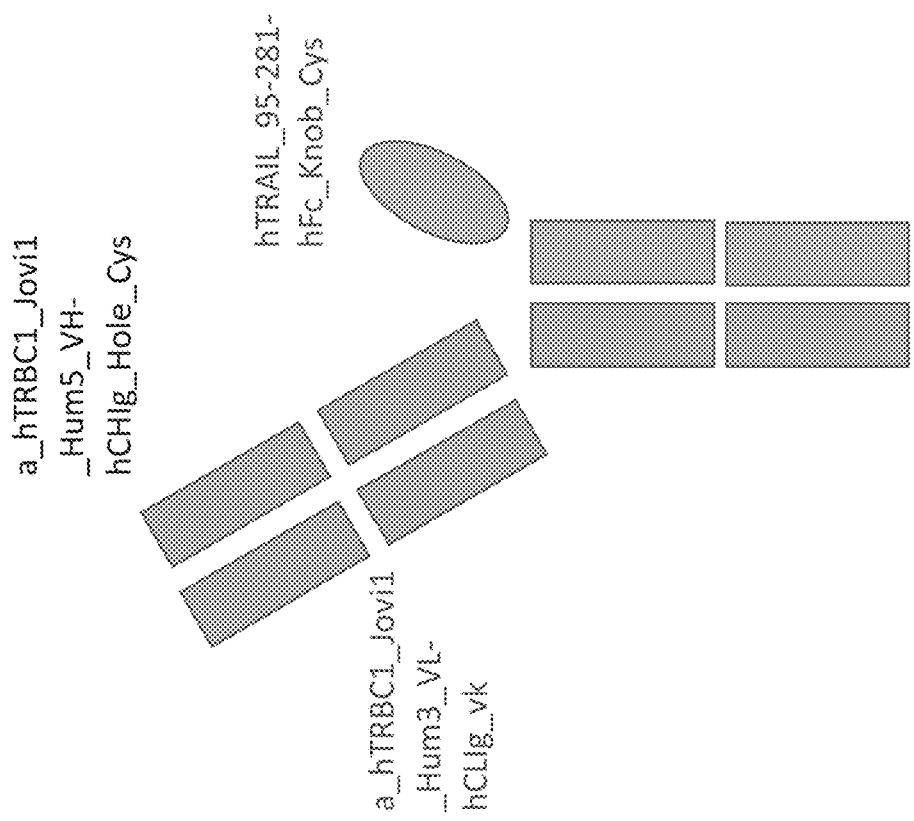
Figure 2F:
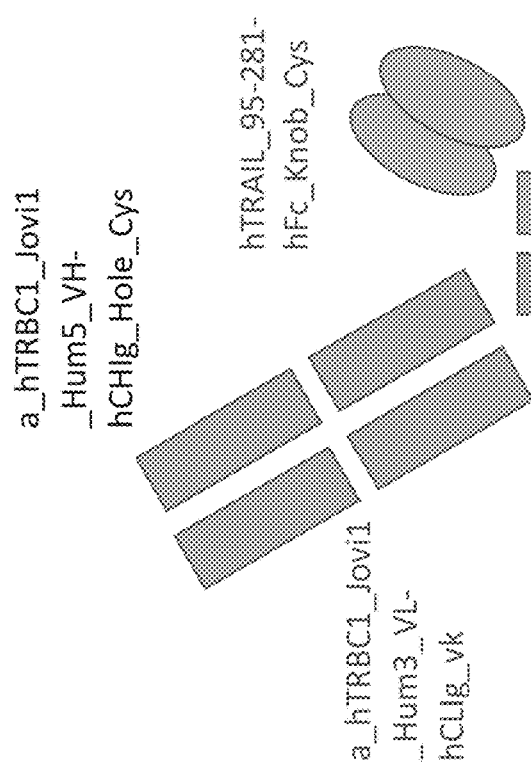

Disclosed herein are multifunctional molecules (also referred to herein as "multispecific molecules") that include a plurality of (e.g., two or more) functionalities (or binding specificities), comprising (i) an antigen binding domain that preferentially binds to TRBC1 or a TRBC2, and (ii) one, two, or all of: (a) an immune cell engager chosen from a T cell engager, an NK cell engager (e.g., a molecule that binds to NKp30, NKp46, NKG2D, or CD16), a B cell engager, a dendritic cell engager, or a macrophage cell engager; (b) a cytokine molecule; and (c) a stromal modifying moiety. Also disclosed herein are antibody molecules comprising an antigen binding domain that preferentially binds to TRBC1 or TRBC2. In some embodiments, the antigen binding domain that binds to TRBC1 or TRBC2 comprises a sequence or part of a sequence found in Tables 2-5. In some embodiments, the immune cell engager comprises an NK cell engager comprising a sequence or part of a sequence found in Tables 7-10. In some embodiments, the antigen binding domain comprises a sequence or part of a sequence found in Tables 2-5 and the immune cell engager comprises an NK cell engager comprising a sequence or part of a sequence found in Tables 7-10.

In an embodiment, the multispecific or multifunctional molecule is a bispecific (or bifunctional) molecule, a trispecific (or trifunctional) molecule, or a tetraspecific (or tetrafunctional) molecule.

In some embodiments, the multifunctional molecule comprises an antigen binding domain that binds a tumor antigen on the surface of a T cell receptor comprising TRBC1 targets immune cells (e.g., via the immune cell engager) to lymphoma cells (e.g., T cells) that exhibit T cell receptors comprising TRBC1.

Without being bound by theory, the multispecific or multifunctional molecules disclosed herein are expected to localize (e.g., bridge) and/or activate an immune cell (e.g., an immune effector cell chosen from a T cell, an NK cell, a B cell, a dendritic cell or a macrophage), in the presence of a cell (e.g., a cancer cell, e.g., lymphoma cell, e.g., T cell) expressing a T cell receptor comprising TRBC1 or TRBC2, e.g., on the surface. Increasing the proximity and/or activity of the immune cell, in the presence of the cell (e.g., cancer cell, e.g., lymphoma cell, e.g., T cell) expressing a T cell receptor comprising TRBC1 or TRBC2, using the multispecific or multifunctional molecules described herein is expected to enhance an immune response against the target cell, thereby providing a more effective therapy.

Without being bound by theory, it is thought that T cells do not typically express T cell receptors comprising TRBC1 and T cell receptors comprising TRBC2. By utilizing, in some embodiments, a multispecific or multifunctional molecule specific for a T cell receptor comprising TRBC1 or a T cell receptor comprising TRBC2, but not with specificity for both types of T cell receptors, it is expected that the deleterious effects of increasing the proximity or activity of immune cells toward T cells generally may be mitigated. In this way, it is thought that use of the multispecific or multifunctional molecules disclosed herein may increase the proximity or activity of immune cells toward cancer cells (e.g., lymphoma cells, e.g., T cells) without necessarily increasing proximity or activity of immune cells toward T cells generally. Novel multifunctional, e.g., multispecific, molecules that include (i) a stromal modifying moiety and (ii) an antigen binding domain that preferentially binds to tumor antigen on a lymphoma cell (e.g., T cell), e.g., a T cell receptor comprising TRBC1 or a T cell receptor comprising TRBC2 are disclosed. Without being bound by theory, the multifunctional molecules disclosed herein are believed to inter alia target (e.g., localize to) a cancer site, and alter the tumor stroma, e.g., alter the tumor microenvironment near the cancer site. The multifunctional molecules can further include one or both of: an immune cell engager (e.g., chosen from one, two, three, or all of a T cell engager, NK cell engager, a B cell engager, a dendritic cell engager, or a macrophage cell engager); and/or a cytokine molecule. Accordingly, provided herein are, inter alia, multifunctional, e.g., multispecific molecules, that include the aforesaid moieties, nucleic acids encoding the same, methods of producing the aforesaid molecules, and methods of treating a cancer using the aforesaid molecules.

Accordingly, provided herein are, inter alia, multispecific or multifunctional molecules (e.g., multispecific or multifunctional antibody molecules) that include the aforesaid moieties, nucleic acids encoding the same, methods of producing the aforesaid molecules, and methods of treating a disease or disorder, e.g., cancer, using the aforesaid molecules.

Definitions

In some embodiments, the multifunctional molecule includes an immune cell engager. "An immune cell engager" refers to one or more binding specificities that bind and/or activate an immune cell, e.g., a cell involved in an immune response. In embodiments, the immune cell is chosen from a T cell, an NK cell, a B cell, a dendritic cell, and/or the macrophage cell. The immune cell engager can be an antibody molecule, a receptor molecule (e.g., a full length receptor, receptor fragment, or fusion thereof (e.g., a receptor-Fc fusion)), or a ligand molecule (e.g., a full length ligand, ligand fragment, or fusion thereof (e.g., a ligand-Fc fusion)) that binds to the immune cell antigen (e.g., the T cell, the NK cell antigen, the B cell antigen, the dendritic cell antigen, and/or the macrophage cell antigen). In embodiments, the immune cell engager specifically binds to the target immune cell, e.g., binds preferentially to the target immune cell. For example, when the immune cell engager is an antibody molecule, it binds to an immune cell antigen (e.g., a T cell antigen, an NK cell antigen, a B cell antigen, a dendritic cell antigen, and/or a macrophage cell antigen) with a dissociation constant of less than about 10 nM.

In some embodiments, the multifunctional molecule includes a cytokine molecule. As used herein, a "cytokine molecule" refers to full length, a fragment or a variant of a cytokine; a cytokine further comprising a receptor domain, e.g., a cytokine receptor dimerizing domain; or an agonist of a cytokine receptor, e.g., an antibody molecule (e.g., an agonistic antibody) to a cytokine receptor, that elicits at least one activity of a naturally-occurring cytokine. In some embodiments the cytokine molecule is chosen from interleukin-2 (IL-2), interleukin-7 (IL-7), interleukin-12 (IL-12), interleukin-15 (IL-15), interleukin-18 (IL-18), interleukin-21 (IL-21), or interferon gamma, or a fragment or variant thereof, or a combination of any of the aforesaid cytokines. The cytokine molecule can be a monomer or a dimer. In embodiments, the cytokine molecule can further include a cytokine receptor dimerizing domain. In other embodiments, the cytokine molecule is an agonist of a cytokine receptor, e.g., an antibody molecule (e.g., an agonistic antibody) to a cytokine receptor chosen from an IL-15Ra or IL-21R.

As used herein, the term "molecule" as used in, e.g., antibody molecule, cytokine molecule, receptor molecule, includes full-length, naturally-occurring molecules, as well as variants, e.g., functional variants (e.g., truncations, fragments, mutated (e.g., substantially similar sequences) or derivatized form thereof), so long as at least one function and/or activity of the unmodified (e.g., naturally-occurring) molecule remains.

In some embodiments, the multifunctional molecule includes a stromal modifying moiety. A "stromal modifying moiety," as used herein refers to an agent, e.g., a protein (e.g., an enzyme), that is capable of altering, e.g., degrading a component of, the stroma. In embodiments, the component of the stroma is chosen from, e.g., an ECM component, e.g., a glycosaminoglycan, e.g., hyaluronan (also known as hyaluronic acid or HA), chondroitin sulfate, chondroitin, dermatan sulfate, heparin sulfate, heparin, entactin, tenascin, aggrecan and keratin sulfate; or an extracellular protein, e.g., collagen, laminin, elastin, fibrinogen, fibronectin, and vitronectin.

Certain terms are defined below.

As used herein, the articles "a" and "an" refer to one or more than one, e.g., to at least one, of the grammatical object of the article. The use of the words "a" or "an" when used in conjunction with the term "comprising" herein may mean "one," but it is also consistent with the meaning of "one or more," "at least one," and "one or more than one."

As used herein, "about" and "approximately" generally mean an acceptable degree of error for the quantity measured given the nature or precision of the measurements. Exemplary degrees of error are within 20 percent (%), typically, within 10%, and more typically, within 5% of a given range of values.

"Antibody molecule" as used herein refers to a protein, e.g., an immunoglobulin chain or fragment thereof, comprising at least one immunoglobulin variable domain sequence. An antibody molecule encompasses antibodies (e.g., full-length antibodies) and antibody fragments.

In an embodiment, an antibody molecule comprises an antigen binding or functional fragment of a full length antibody, or a full length immunoglobulin chain. For example, a full-length antibody is an immunoglobulin (Ig) molecule (e.g., an IgG antibody) that is naturally occurring or formed by normal immunoglobulin gene fragment recombinatorial processes). In embodiments, an antibody molecule refers to an immunologically active, antigen-binding portion of an immunoglobulin molecule, such as an antibody fragment. An antibody fragment, e.g., functional fragment, is a portion of an antibody, e.g., Fab, Fab', F(ab')$_2$, F(ab)$_2$, variable fragment (Fv), domain antibody (dAb), or single chain variable fragment (scFv). A functional antibody fragment binds to the same antigen as that recognized by the intact (e.g., full-length) antibody. The terms "antibody fragment" or "functional fragment" also include isolated fragments consisting of the variable regions, such as the "Fv" fragments consisting of the variable regions of the heavy and light chains or recombinant single chain polypeptide molecules in which light and heavy variable regions are connected by a peptide linker ("scFv proteins"). In some embodiments, an antibody fragment does not include portions of antibodies without antigen binding activity, such as Fc fragments or single amino acid residues. Exemplary antibody molecules include full length antibodies and antibody fragments, e.g., dAb (domain antibody), single chain, Fab, Fab', and F(ab')$_2$ fragments, and single chain variable fragments (scFvs).

As used herein, an "immunoglobulin variable domain sequence" refers to an amino acid sequence which can form the structure of an immunoglobulin variable domain. For example, the sequence may include all or part of the amino acid sequence of a naturally-occurring variable domain. For example, the sequence may or may not include one, two, or more N- or C-terminal amino acids, or may include other alterations that are compatible with formation of the protein structure.

In embodiments, an antibody molecule is monospecific, e.g., it comprises binding specificity for a single epitope. In some embodiments, an antibody molecule is multispecific, e.g., it comprises a plurality of immunoglobulin variable domain sequences, where a first immunoglobulin variable domain sequence has binding specificity for a first epitope and a second immunoglobulin variable domain sequence has binding specificity for a second epitope.

In some embodiments, an antibody molecule is a bispecific antibody molecule. "Bispecific antibody molecule" as used herein refers to an antibody molecule that has specificity for more than one (e.g., two, three, four, or more) epitope and/or antigen.

"Antigen" (Ag) as used herein refers to a molecule that can provoke an immune response, e.g., involving activation of certain immune cells and/or antibody generation. Any macromolecule, including almost all proteins or peptides, can be an antigen. Antigens can also be derived from genomic recombinant or DNA. For example, any DNA comprising a nucleotide sequence or a partial nucleotide sequence that encodes a protein capable of eliciting an immune response encodes an "antigen." In embodiments, an antigen does not need to be encoded solely by a full length nucleotide sequence of a gene, nor does an antigen need to be encoded by a gene at all. In embodiments, an antigen can be synthesized or can be derived from a biological sample, e.g., a tissue sample, a tumor sample, a cell, or a fluid with other biological components. As used, herein a "tumor antigen" or interchangeably, a "cancer antigen" includes any molecule present on, or associated with, a cancer, e.g., a cancer cell or a tumor microenvironment that can provoke an immune response. As used, herein an "immune cell antigen" includes any molecule present on, or associated with, an immune cell that can provoke an immune response.

The "antigen-binding site," or "binding portion" of an antibody molecule refers to the part of an antibody molecule, e.g., an immunoglobulin (Ig) molecule, that participates in antigen binding. In embodiments, the antigen binding site is formed by amino acid residues of the variable (V) regions of the heavy (H) and light (L) chains. Three highly divergent stretches within the variable regions of the heavy and light chains, referred to as hypervariable regions, are disposed between more conserved flanking stretches called "framework regions," (FRs). FRs are amino acid sequences that are naturally found between, and adjacent to, hypervariable regions in immunoglobulins. In embodiments, in an antibody molecule, the three hypervariable regions of a light chain and the three hypervariable regions of a heavy chain are disposed relative to each other in three dimensional space to form an antigen-binding surface, which is complementary to the three-dimensional surface of a bound antigen. The three hypervariable regions of each of the heavy and light chains are referred to as "complementarity-determining regions," or "CDRs." The framework region and CDRs have been defined and described, e.g., in Kabat, E. A., et al. (1991) Sequences of Proteins of Immunological Interest, Fifth Edition, U.S. Department of Health and Human Services, NIH Publication No. 91-3242, and Chothia, C. et al. (1987) J. Mol. Biol. 196:901-917. Each variable chain (e.g., variable heavy chain and variable light chain) is typically made up of three CDRs and four FRs, arranged from amino-terminus to carboxy-terminus in the amino acid order: FR1, CDR1, FR2, CDR2, FR3, CDR3, and FR4.

"Cancer" as used herein can encompass all types of oncogenic processes and/or cancerous growths. In embodiments, cancer includes primary tumors as well as metastatic tissues or malignantly transformed cells, tissues, or organs. In embodiments, cancer encompasses all histopathologies and stages, e.g., stages of invasiveness/severity, of a cancer. In embodiments, cancer includes relapsed and/or resistant cancer. The terms "cancer" and "tumor" can be used interchangeably. For example, both terms encompass solid and liquid tumors. As used herein, the term "cancer" or "tumor" includes premalignant, as well as malignant cancers and tumors.

As used herein, an "immune cell" refers to any of various cells that function in the immune system, e.g., to protect against agents of infection and foreign matter. In embodiments, this term includes leukocytes, e.g., neutrophils, eosinophils, basophils, lymphocytes, and monocytes. Innate leukocytes include phagocytes (e.g., macrophages, neutrophils, and dendritic cells), mast cells, eosinophils, basophils, and natural killer cells. Innate leukocytes identify and eliminate pathogens, either by attacking larger pathogens through contact or by engulfing and then killing microorganisms, and are mediators in the activation of an adaptive immune response. The cells of the adaptive immune system are special types of leukocytes, called lymphocytes. B cells and T cells are important types of lymphocytes and are derived from hematopoietic stem cells in the bone marrow. B cells are involved in the humoral immune response, whereas T cells are involved in cell-mediated immune response. The term "immune cell" includes immune effector cells.

"Immune effector cell," as that term is used herein, refers to a cell that is involved in an immune response, e.g., in the promotion of an immune effector response. Examples of immune effector cells include, but are not limited to, T cells, e.g., alpha/beta T cells and gamma/delta T cells, B cells, natural killer (NK) cells, natural killer T (NK T) cells, and mast cells.

The term "effector function" or "effector response" refers to a specialized function of a cell. Effector function of a T cell, for example, may be cytolytic activity or helper activity including the secretion of cytokines.

The compositions and methods of the present invention encompass polypeptides and nucleic acids having the sequences specified, or sequences substantially identical or similar thereto, e.g., sequences at least 80%, 85%, 90%, 95% identical or higher to the sequence specified. In the context of an amino acid sequence, the term "substantially identical" is used herein to refer to a first amino acid that contains a sufficient or minimum number of amino acid residues that are i) identical to, or ii) conservative substitutions of aligned amino acid residues in a second amino acid sequence such that the first and second amino acid sequences can have a common structural domain and/or common functional activity. For example, amino acid sequences that contain a common structural domain having at least about 80%, 85%, 90%, 91%, 92%, 93%, 94%, 95%, 96%, 97%, 98% or 99% identity to a reference sequence, e.g., a sequence provided herein.

In the context of nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity. For example, nucleotide sequences having at least about 80%, 85%, 90%, 91%, 92%, 93%, 94%, 95%, 96%, 97%, 98% or 99% identity to a reference sequence, e.g., a sequence provided herein.

The term "variant" refers to a polypeptide that has a substantially identical amino acid sequence to a reference amino acid sequence, or is encoded by a substantially identical nucleotide sequence. In some embodiments, the variant is a functional variant.

The term "functional variant" refers to a polypeptide that has a substantially identical amino acid sequence to a reference amino acid sequence, or is encoded by a substantially identical nucleotide sequence, and is capable of having one or more activities of the reference amino acid sequence.

Calculations of homology or sequence identity between sequences (the terms are used interchangeably herein) are performed as follows.

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology").

The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch ((1970) J. Mol. Biol. 48:444-453) algorithm which has been incorporated into the GAP program in the GCG software package (available at www.gcg.com), using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (available at www.gcg.com), using a NWSgapdna.CMP matrix and a gap weight of 40, 50, 60, 70, or 80 and a length weight of 1, 2, 3, 4, 5, or 6. A particularly preferred set of parameters (and the one that should be used unless otherwise specified) are a Blossum 62 scoring matrix with a gap penalty of 12, a gap extend penalty of 4, and a frameshift gap penalty of 5.

The percent identity between two amino acid or nucleotide sequences can be determined using the algorithm of E. Meyers and W. Miller ((1989) CABIOS, 4:11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al. (1990) J. Mol. Biol. 215: 403-10. BLAST nucleotide searches can be performed with the NBLAST program, score=100, wordlength=12 to obtain nucleotide sequences homologous to a nucleic acid molecule of the invention. BLAST protein searches can be performed with the XBLAST program, score=50, wordlength=3 to obtain amino acid sequences homologous to protein molecules of the invention. To obtain gapped alignments for comparison purposes, Gapped BLAST can be utilized as described in Altschul et al., (1997) Nucleic Acids Res. 25:3389-3402. When utilizing BLAST and Gapped BLAST programs, the default parameters of the respective programs (e.g., XBLAST and NBLAST) can be used. See www.ncbi.nlm.nih.gov.

It is understood that the molecules of the present invention may have additional conservative or non-essential amino acid substitutions, which do not have a substantial effect on their functions.

The term "amino acid" is intended to embrace all molecules, whether natural or synthetic, which include both an amino functionality and an acid functionality and capable of being included in a polymer of naturally-occurring amino acids. Exemplary amino acids include naturally-occurring amino acids; analogs, derivatives and congeners thereof, amino acid analogs having variant side chains; and all stereoisomers of any of any of the foregoing. As used herein the term "amino acid" includes both the D- or L-optical isomers and peptidomimetics.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

The terms "polypeptide", "peptide" and "protein" (if single chain) are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. The polypeptide can be isolated from natural sources, can be a produced by recombinant techniques from a eukaryotic or prokaryotic host, or can be a product of synthetic procedures.

The terms "nucleic acid," "nucleic acid sequence," "nucleotide sequence," or "polynucleotide sequence," and "polynucleotide" are used interchangeably. They refer to a polymeric form of nucleotides of any length, either deoxyribonucleotides or ribonucleotides, or analogs thereof. The polynucleotide may be either single-stranded or double-stranded, and if single-stranded may be the coding strand or non-coding (antisense) strand. A polynucleotide may comprise modified nucleotides, such as methylated nucleotides and nucleotide analogs. The sequence of nucleotides may be interrupted by non-nucleotide components. A polynucleotide may be further modified after polymerization, such as by conjugation with a labeling component. The nucleic acid may be a recombinant polynucleotide, or a polynucleotide of genomic, cDNA, semisynthetic, or synthetic origin which either does not occur in nature or is linked to another polynucleotide in a non-natural arrangement.

The term "isolated," as used herein, refers to material that is removed from its original or native environment (e.g., the natural environment if it is naturally occurring). For example, a naturally-occurring polynucleotide or polypeptide present in a living animal is not isolated, but the same polynucleotide or polypeptide, separated by human intervention from some or all of the co-existing materials in the natural system, is isolated. Such polynucleotides could be part of a vector and/or such polynucleotides or polypeptides could be part of a composition, and still be isolated in that such vector or composition is not part of the environment in which it is found in nature.

Various aspects of the invention are described in further detail below. Additional definitions are set out throughout the specification.

Antibody Molecules

In one embodiment, the antibody molecule binds to a cancer antigen, e.g., a tumor antigen or a stromal antigen. In some embodiments, the cancer antigen is, e.g., a mammalian, e.g., a human, cancer antigen. In other embodiments, the antibody molecule binds to an immune cell antigen, e.g., a mammalian, e.g., a human, immune cell antigen. For example, the antibody molecule binds specifically to an epitope, e.g., linear or conformational epitope, on the cancer antigen or the immune cell antigen.

In an embodiment, an antibody molecule is a monospecific antibody molecule and binds a single epitope. E.g., a monospecific antibody molecule having a plurality of immunoglobulin variable domain sequences, each of which binds the same epitope.

In an embodiment an antibody molecule is a multispecific or multifunctional antibody molecule, e.g., it comprises a plurality of immunoglobulin variable domains sequences, wherein a first immunoglobulin variable domain sequence of the plurality has binding specificity for a first epitope and a second immunoglobulin variable domain sequence of the plurality has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., the different proteins (or different subunits of a multimeric protein). In an embodiment a multispecific antibody molecule comprises a third, fourth or fifth immunoglobulin variable domain. In an embodiment, a multispecific antibody molecule is a bispecific antibody molecule, a trispecific antibody molecule, or a tetraspecific antibody molecule.

In an embodiment a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., the different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv or a Fab, or fragment thereof, have binding specificity for a first epitope and a scFv or a Fab, or fragment thereof, have binding specificity for a second epitope.

In an embodiment, an antibody molecule comprises a diabody, and a single-chain molecule, as well as an antigen-binding fragment of an antibody (e.g., Fab, F(ab')$_2$, and Fv). For example, an antibody molecule can include a heavy (H) chain variable domain sequence (abbreviated herein as VH), and a light (L) chain variable domain sequence (abbreviated herein as VL). In an embodiment an antibody molecule comprises or consists of a heavy chain and a light chain (referred to herein as a half antibody. In another example, an antibody molecule includes two heavy (H) chain variable domain sequences and two light (L) chain variable domain sequence, thereby forming two antigen binding sites, such as Fab, Fab', F(ab')$_2$, Fc, Fd, Fd', Fv, single chain antibodies (scFv for example), single variable domain antibodies, diabodies (Dab) (bivalent and bispecific), and chimeric (e.g., humanized) antibodies, which may be produced by the modification of whole antibodies or those synthesized de novo using recombinant DNA technologies. These functional antibody fragments retain the ability to selectively bind with their respective antigen or receptor. Antibodies and antibody fragments can be from any class of antibodies including, but not limited to, IgG, IgA, IgM, IgD, and IgE, and from any subclass (e.g., IgG1, IgG2, IgG3, and IgG4) of antibodies. The a preparation of antibody molecules can be monoclonal or polyclonal. An antibody molecule can also be a human, humanized, CDR-grafted, or in vitro generated antibody. The antibody can have a heavy chain constant region chosen from, e.g., IgG1, IgG2, IgG3, or IgG4. The antibody can also have a light chain chosen from, e.g., kappa or lambda. The term "immunoglobulin" (Ig) is used interchangeably with the term "antibody" herein.

Examples of antigen-binding fragments of an antibody molecule include: (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a diabody (dAb) fragment, which consists of a VH domain; (vi) a camelid or camelized variable domain; (vii) a single chain Fv (scFv), see e.g., Bird et al. (1988) *Science* 242:423-426; and Huston et al. (1988) *Proc. Natl. Acad. Sci. USA* 85:5879-5883); (viii) a single domain antibody. These antibody fragments are obtained using conventional techniques known to those with skill in the art, and the fragments are screened for utility in the same manner as are intact antibodies.

Antibody molecules include intact molecules as well as functional fragments thereof. Constant regions of the antibody molecules can be altered, e.g., mutated, to modify the properties of the antibody (e.g., to increase or decrease one or more of: Fc receptor binding, antibody glycosylation, the number of cysteine residues, effector cell function, or complement function).

Antibody molecules can also be single domain antibodies. Single domain antibodies can include antibodies whose complementary determining regions are part of a single domain polypeptide. Examples include, but are not limited to, heavy chain antibodies, antibodies naturally devoid of light chains, single domain antibodies derived from conventional 4-chain antibodies, engineered antibodies and single domain scaffolds other than those derived from antibodies. Single domain antibodies may be any of the art, or any future single domain antibodies. Single domain antibodies may be derived from any species including, but not limited to mouse, human, camel, llama, fish, shark, goat, rabbit, and bovine. According to another aspect of the invention, a single domain antibody is a naturally occurring single domain antibody known as heavy chain antibody devoid of light chains. Such single domain antibodies are disclosed in WO 9404678, for example. For clarity reasons, this variable domain derived from a heavy chain antibody naturally devoid of light chain is known herein as a VHH or nanobody to distinguish it from the conventional VH of four chain immunoglobulins. Such a VHH molecule can be derived from antibodies raised in Camelidae species, for example in camel, llama, dromedary, alpaca and guanaco. Other species besides Camelidae may produce heavy chain antibodies naturally devoid of light chain; such VHHs are within the scope of the invention.

The VH and VL regions can be subdivided into regions of hypervariability, termed "complementarity determining regions" (CDR), interspersed with regions that are more conserved, termed "framework regions" (FR or FW).

The extent of the framework region and CDRs has been precisely defined by a number of methods (see, Kabat, E. A., et al. (1991) Sequences of Proteins of Immunological Interest, Fifth Edition, U.S. Department of Health and Human Services, NIH Publication No. 91-3242; Chothia, C. et al. (1987) *J. Mol. Biol.* 196:901-917; and the AbM definition used by Oxford Molecular's AbM antibody modeling software. See, generally, e.g., *Protein Sequence and Structure Analysis of Antibody Variable Domains*. In: Antibody Engineering Lab Manual (Ed.: Duebel, S. and Kontermann, R., Springer-Verlag, Heidelberg).

The terms "complementarity determining region," and "CDR," as used herein refer to the sequences of amino acids within antibody variable regions which confer antigen specificity and binding affinity. In general, there are three CDRs in each heavy chain variable region (HCDR1, HCDR2, HCDR3) and three CDRs in each light chain variable region (LCDR1, LCDR2, LCDR3).

The precise amino acid sequence boundaries of a given CDR can be determined using any of a number of known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) *JMB* 273, 927-948 ("Chothia" numbering scheme). As used herein, the CDRs defined according the "Chothia" number scheme are also sometimes referred to as "hypervariable loops."

For example, under Kabat, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under Chothia, the CDR amino acids in the VH are numbered 26-32 (HCDR1), 52-56 (HCDR2), and 95-102 (HCDR3); and the amino acid residues in VL are numbered 26-32 (LCDR1), 50-52 (LCDR2), and 91-96 (LCDR3).

Each VH and VL typically includes three CDRs and four FRs, arranged from amino-terminus to carboxy-terminus in the following order: FR1, CDR1, FR2, CDR2, FR3, CDR3, FR4.

The antibody molecule can be a polyclonal or a monoclonal antibody.

The terms "monoclonal antibody" or "monoclonal antibody composition" as used herein refer to a preparation of antibody molecules of single molecular composition. A monoclonal antibody composition displays a single binding specificity and affinity for a particular epitope. A monoclonal antibody can be made by hybridoma technology or by methods that do not use hybridoma technology (e.g., recombinant methods).

The antibody can be recombinantly produced, e.g., produced by phage display or by combinatorial methods.

Phage display and combinatorial methods for generating antibodies are known in the art (as described in, e.g., Ladner et al. U.S. Pat. No. 5,223,409; Kang et al. International Publication No. WO 92/18619; Dower et al. International Publication No. WO 91/17271; Winter et al. International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) *Bio/Technology* 9:1370-1372; Hay et al. (1992) *Hum Antibod Hybridomas* 3:81-85; Huse et al. (1989) *Science* 246:1275-1281; Griffiths et al. (1993) *EMBO J* 12:725-734; Hawkins et al. (1992) *J Mol Biol* 226:889-896; Clackson et al. (1991) *Nature* 352:624-628; Gram et al. (1992) *PNAS* 89:3576-3580; Garrad et al. (1991) *Bio Technology* 9:1373-1377; Hoogenboom et al. (1991) *Nuc Acid Res* 19:4133-4137; and Barbas et al. (1991) *PNAS* 88:7978-7982, the contents of all of which are incorporated by reference herein).

In one embodiment, the antibody is a fully human antibody (e.g., an antibody made in a mouse which has been genetically engineered to produce an antibody from a human immunoglobulin sequence), or a non-human antibody, e.g., a rodent (mouse or rat), goat, primate (e.g., monkey), camel antibody. Preferably, the non-human antibody is a rodent (mouse or rat antibody). Methods of producing rodent antibodies are known in the art.

Human monoclonal antibodies can be generated using transgenic mice carrying the human immunoglobulin genes rather than the mouse system. Splenocytes from these transgenic mice immunized with the antigen of interest are used to produce hybridomas that secrete human mAbs with specific affinities for epitopes from a human protein (see, e.g., Wood et al. International Application WO 91/00906, Kucherlapati et al. PCT publication WO 91/10741; Lonberg et al. International Application WO 92/03918; Kay et al. International Application 92/03917; Lonberg, N. et al. 1994 *Nature* 368:856-859; Green, L. L. et al. 1994 *Nature Genet.* 7:13-21; Morrison, S. L. et al. 1994 *Proc. Natl. Acad. Sci. USA* 81:6851-6855; Bruggeman et al. 1993 *Year Immunol* 7:33-40; Tuaillon et al. 1993 *PNAS* 90:3720-3724; Bruggeman et al. 1991 *Eur J Immunol* 21:1323-1326).

An antibody molecule can be one in which the variable region, or a portion thereof, e.g., the CDRs, are generated in a non-human organism, e.g., a rat or mouse. Chimeric, CDR-grafted, and humanized antibodies are within the invention. Antibody molecules generated in a non-human organism, e.g., a rat or mouse, and then modified, e.g., in the variable framework or constant region, to decrease antigenicity in a human are within the invention.

An "effectively human" protein is a protein that does substantially not evoke a neutralizing antibody response, e.g., the human anti-murine antibody (HAMA) response. HAMA can be problematic in a number of circumstances, e.g., if the antibody molecule is administered repeatedly, e.g., in treatment of a chronic or recurrent disease condition. A HAMA response can make repeated antibody administration potentially ineffective because of an increased antibody clearance from the serum (see, e.g., Saleh et al., Cancer Immunol. Immunother., 32:180-190 (1990)) and also because of potential allergic reactions (see, e.g., LoBuglio et al., Hybridoma, 5:5117-5123 (1986)).

Chimeric antibodies can be produced by recombinant DNA techniques known in the art (see Robinson et al., International Patent Publication PCT/US86/02269; Akira, et al., European Patent Application 184,187; Taniguchi, M., European Patent Application 171,496; Morrison et al., European Patent Application 173,494; Neuberger et al., International Application WO 86/01533; Cabilly et al. U.S. Pat. No. 4,816,567; Cabilly et al., European Patent Application 125, 023; Better et al. (1988 Science 240:1041-1043); Liu et al. (1987) PNAS 84:3439-3443; Liu et al., 1987, J. Immunol. 139:3521-3526; Sun et al. (1987) PNAS 84:214-218; Nishimura et al., 1987, Canc. Res. 47:999-1005; Wood et al. (1985) Nature 314:446-449; and Shaw et al., 1988, J. Natl Cancer Inst. 80:1553-1559).

A humanized or CDR-grafted antibody will have at least one or two but generally all three recipient CDRs (of heavy and or light immuoglobulin chains) replaced with a donor CDR. The antibody may be replaced with at least a portion of a non-human CDR or only some of the CDRs may be replaced with non-human CDRs. It is only necessary to replace the number of CDRs required for binding to the antigen. Preferably, the donor will be a rodent antibody, e.g., a rat or mouse antibody, and the recipient will be a human framework or a human consensus framework. Typically, the immunoglobulin providing the CDRs is called the "donor" and the immunoglobulin providing the framework is called the "acceptor." In one embodiment, the donor immunoglobulin is a non-human (e.g., rodent). The acceptor framework is a naturally-occurring (e.g., a human) framework or a consensus framework, or a sequence about 85% or higher, preferably 90%, 95%, 99% or higher identical thereto.

As used herein, the term "consensus sequence" refers to the sequence formed from the most frequently occurring amino acids (or nucleotides) in a family of related sequences (See e.g., Winnaker, From Genes to Clones (Verlagsgesellschaft, Weinheim, Germany 1987). In a family of proteins, each position in the consensus sequence is occupied by the amino acid occurring most frequently at that position in the family. If two amino acids occur equally frequently, either can be included in the consensus sequence. A "consensus framework" refers to the framework region in the consensus immunoglobulin sequence.

An antibody molecule can be humanized by methods known in the art (see e.g., Morrison, S. L., 1985, Science 229:1202-1207, by Oi et al., 1986, BioTechniques 4:214, and by Queen et al. U.S. Pat. Nos. 5,585,089, 5,693,761 and 5,693,762, the contents of all of which are hereby incorporated by reference).

Humanized or CDR-grafted antibody molecules can be produced by CDR-grafting or CDR substitution, wherein one, two, or all CDRs of an immunoglobulin chain can be replaced. See e.g., U.S. Pat. No. 5,225,539; Jones et al. 1986 Nature 321:552-525; Verhoeyan et al. 1988 Science 239: 1534; Beidler et al. 1988 J. Immunol. 141:4053-4060; Winter U.S. Pat. No. 5,225,539, the contents of all of which are hereby expressly incorporated by reference. Winter describes a CDR-grafting method which may be used to prepare the humanized antibodies of the present invention (UK Patent Application GB 2188638A, filed on Mar. 26, 1987; Winter U.S. Pat. No. 5,225,539), the contents of which is expressly incorporated by reference.

Also within the scope of the invention are humanized antibody molecules in which specific amino acids have been substituted, deleted or added. Criteria for selecting amino acids from the donor are described in U.S. Pat. No. 5,585, 089, e.g., columns 12-16 of U.S. Pat. No. 5,585,089, e.g., columns 12-16 of U.S. Pat. No. 5,585,089, the contents of which are hereby incorporated by reference. Other techniques for humanizing antibodies are described in Padlan et al. EP 519596 A1, published on Dec. 23, 1992.

The antibody molecule can be a single chain antibody. A single-chain antibody (scFv) may be engineered (see, for example, Colcher, D. et al. (1999) Ann NY Acad Sci 880: 263-80; and Reiter, Y. (1996) Clin Cancer Res 2:245-52). The single chain antibody can be dimerized or multimerized to generate multivalent antibodies having specificities for different epitopes of the same target protein.

In yet other embodiments, the antibody molecule has a heavy chain constant region chosen from, e.g., the heavy chain constant regions of IgG1, IgG2, IgG3, IgG4, IgM, IgA1, IgA2, IgD, and IgE; particularly, chosen from, e.g., the (e.g., human) heavy chain constant regions of IgG1, IgG2, IgG3, and IgG4. In another embodiment, the antibody molecule has a light chain constant region chosen from, e.g., the (e.g., human) light chain constant regions of kappa or lambda. The constant region can be altered, e.g., mutated, to modify the properties of the antibody (e.g., to increase or decrease one or more of: Fc receptor binding, antibody glycosylation, the number of cysteine residues, effector cell function, and/or complement function). In one embodiment the antibody has: effector function; and can fix complement. In other embodiments the antibody does not; recruit effector cells; or fix complement. In another embodiment, the antibody has reduced or no ability to bind an Fc receptor. For example, it is a isotype or subtype, fragment or other mutant, which does not support binding to an Fc receptor, e.g., it has a mutagenized or deleted Fc receptor binding region.

Methods for altering an antibody constant region are known in the art. Antibodies with altered function, e.g. altered affinity for an effector ligand, such as FcR on a cell, or the C1 component of complement can be produced by replacing at least one amino acid residue in the constant portion of the antibody with a different residue (see e.g., EP 388,151 A1, U.S. Pat. Nos. 5,624,821 and 5,648,260, the contents of all of which are hereby incorporated by reference). Similar type of alterations could be described which if applied to the murine, or other species immunoglobulin would reduce or eliminate these functions.

An antibody molecule can be derivatized or linked to another functional molecule (e.g., another peptide or protein). As used herein, a "derivatized" antibody molecule is one that has been modified. Methods of derivatization include but are not limited to the addition of a fluorescent moiety, a radionucleotide, a toxin, an enzyme or an affinity ligand such as biotin.

Accordingly, the antibody molecules of the invention are intended to include derivatized and otherwise modified forms of the antibodies described herein, including immunoadhesion molecules. For example, an antibody molecule can be functionally linked (by chemical coupling, genetic fusion, noncovalent association or otherwise) to one or more other molecular entities, such as another antibody (e.g., a bispecific antibody or a diabody), a detectable agent, a cytotoxic agent, a pharmaceutical agent, and/or a protein or peptide that can mediate association of the antibody or antibody portion with another molecule (such as a streptavidin core region or a polyhistidine tag).

One type of derivatized antibody molecule is produced by crosslinking two or more antibodies (of the same type or of different types, e.g., to create bispecific antibodies). Suitable crosslinkers include those that are heterobifunctional, having two distinctly reactive groups separated by an appropriate spacer (e.g., m-maleimidobenzoyl-N-hydroxysuccinimide ester) or homobifunctional (e.g., disuccinimidyl suberate). Such linkers are available from Pierce Chemical Company, Rockford, Ill.

Multispecific or Multifunctional Antibody Molecules

Exemplary structures of multispecific and multifunctional molecules defined herein are described throughout. Exemplary structures are further described in: Weidle U et al. (2013) The Intriguing Options of Multispecific Antibody Formats for Treatment of Cancer. *Cancer Genomics & Proteomics* 10: 1-18 (2013); and Spiess C et al. (2015) Alternative molecular formats and therapeutic applications for bispecific antibodies. *Molecular Immunology* 67: 95-106; the full contents of each of which is incorporated by reference herein).

In embodiments, multispecific antibody molecules can comprise more than one antigen-binding site, where different sites are specific for different antigens. In embodiments, multispecific antibody molecules can bind more than one (e.g., two or more) epitopes on the same antigen. In embodiments, multispecific antibody molecules comprise an antigen-binding site specific for a target cell (e.g., cancer cell) and a different antigen-binding site specific for an immune effector cell. In one embodiment, the multispecific antibody molecule is a bispecific antibody molecule. Bispecific antibody molecules can be classified into five different structural groups: (i) bispecific immunoglobulin G (BsIgG); (ii) IgG appended with an additional antigen-binding moiety; (iii) bispecific antibody fragments; (iv) bispecific fusion proteins; and (v) bispecific antibody conjugates.

BsIgG is a format that is monovalent for each antigen. Exemplary BsIgG formats include but are not limited to crossMab, DAF (two-in-one), DAF (four-in-one), DutaMab, DT-IgG, knobs-in-holes common LC, knobs-in-holes assembly, charge pair, Fab-arm exchange, SEEDbody, triomab, LUZ-Y, Fcab, κλ-body, orthogonal Fab. See Spiess et al. Mol. Immunol. 67(2015):95-106. Exemplary BsIgGs include catumaxomab (Fresenius Biotech, Trion Pharma, Neopharm), which contains an anti-CD3 arm and an anti-EpCAM arm; and ertumaxomab (Neovii Biotech, Fresenius Biotech), which targets CD3 and HER2. In some embodiments, BsIgG comprises heavy chains that are engineered for heterodimerization. For example, heavy chains can be engineered for heterodimerization using a "knobs-into-holes" strategy, a SEED platform, a common heavy chain (e.g., in κλ-bodies), and use of heterodimeric Fc regions. See Spiess et al. Mol. Immunol. 67(2015):95-106. Strategies that have been used to avoid heavy chain pairing of homodimers in BsIgG include knobs-in-holes, duobody, azymetric, charge pair, HA-TF, SEEDbody, and differential protein A affinity. See Id. BsIgG can be produced by separate expression of the component antibodies in different host cells and subsequent purification/assembly into a BsIgG. BsIgG can also be produced by expression of the component antibodies in a single host cell. BsIgG can be purified using affinity chromatography, e.g., using protein A and sequential pH elution.

IgG appended with an additional antigen-binding moiety is another format of bispecific antibody molecules. For example, monospecific IgG can be engineered to have bispecificity by appending an additional antigen-binding unit onto the monospecific IgG, e.g., at the N- or C-terminus of either the heavy or light chain. Exemplary additional antigen-binding units include single domain antibodies (e.g., variable heavy chain or variable light chain), engineered protein scaffolds, and paired antibody variable domains (e.g., single chain variable fragments or variable fragments). See Id. Examples of appended IgG formats include dual variable domain IgG (DVD-Ig), IgG(H)-scFv, scFv-(H)IgG, IgG(L)-scFv, scFv-(L)IgG, IgG(L,H)-Fv, IgG(H)-V, V(H)-IgG, IgG(L)-V, V(L)-IgG, KIH IgG-scFab, 2scFv-IgG, IgG-2scFv, scFv4-Ig, zybody, and DVI-IgG (four-in-one). See Spiess et al. Mol. Immunol. 67(2015):95-106. An example of an IgG-scFv is MM-141 (Merrimack Pharmaceuticals), which binds IGF-1R and HER3. Examples of DVD-Ig include ABT-981 (AbbVie), which binds IL-1α and IL-1β; and ABT-122 (AbbVie), which binds TNF and IL-17A.

Bispecific antibody fragments (BsAb) are a format of bispecific antibody molecules that lack some or all of the antibody constant domains. For example, some BsAb lack an Fc region. In embodiments, bispecific antibody fragments include heavy and light chain regions that are connected by a peptide linker that permits efficient expression of the BsAb in a single host cell. Exemplary bispecific antibody fragments include but are not limited to nanobody, nanobody-HAS, BiTE, Diabody, DART, TandAb, scDiabody, scDiabody-CH3, Diabody-CH3, triple body, miniantibody, minibody, TriBi minibody, scFv-CH3 KIH, Fab-scFv, scFv-CH-CL-scFv, F(ab')2, F(ab')2-scFv2, scFv-KIH, Fab-scFv-Fc, tetravalent HCAb, scDiabody-Fc, Diabody-Fc, tandem scFv-Fc, and intrabody. See Id. For example, the BiTE format comprises tandem scFvs, where the component scFvs bind to CD3 on T cells and a surface antigen on cancer cells Bispecific fusion proteins include antibody fragments linked to other proteins, e.g., to add additional specificity and/or functionality. An example of a bispecific fusion protein is an immTAC, which comprises an anti-CD3 scFv linked to an affinity-matured T-cell receptor that recognizes HLA-presented peptides. In embodiments, the dock-and-lock (DNL) method can be used to generate bispecific antibody molecules with higher valency. Also, fusions to albumin binding proteins or human serum albumin can be extend the serum half-life of antibody fragments. See Id.

In embodiments, chemical conjugation, e.g., chemical conjugation of antibodies and/or antibody fragments, can be used to create BsAb molecules. See Id. An exemplary bispecific antibody conjugate includes the CovX-body format, in which a low molecular weight drug is conjugated site-specifically to a single reactive lysine in each Fab arm or an antibody or fragment thereof. In embodiments, the conjugation improves the serum half-life of the low molecular weight drug. An exemplary CovX-body is CVX-241 (NCT01004822), which comprises an antibody conjugated to two short peptides inhibiting either VEGF or Ang2. See Id.

The antibody molecules can be produced by recombinant expression, e.g., of at least one or more component, in a host system. Exemplary host systems include eukaryotic cells (e.g., mammalian cells, e.g., CHO cells, or insect cells, e.g., SF9 or S2 cells) and prokaryotic cells (e.g., *E. coli*). Bispecific antibody molecules can be produced by separate expression of the components in different host cells and subsequent purification/assembly. Alternatively, the antibody molecules can be produced by expression of the components in a single host cell. Purification of bispecific antibody molecules can be performed by various methods such as affinity chromatography, e.g., using protein A and sequential pH elution. In other embodiments, affinity tags can be used for purification, e.g., histidine-containing tag, myc tag, or streptavidin tag.

CDR-Grafted Scaffolds

In embodiments, the antibody molecule is a CDR-grafted scaffold domain. In embodiments, the scaffold domain is based on a fibronectin domain, e.g., fibronectin type III domain. The overall fold of the fibronectin type III (Fn3) domain is closely related to that of the smallest functional antibody fragment, the variable domain of the antibody heavy chain. There are three loops at the end of Fn3; the positions of BC, DE and FG loops approximately correspond to those of CDR1, 2 and 3 of the VH domain of an antibody. Fn3 does not have disulfide bonds; and therefore Fn3 is stable under reducing conditions, unlike antibodies and their fragments (see, e.g., WO 98/56915; WO 01/64942; WO 00/34784). An Fn3 domain can be modified (e.g., using CDRs or hypervariable loops described herein) or varied, e.g., to select domains that bind to an antigen/marker/cell described herein.

In embodiments, a scaffold domain, e.g., a folded domain, is based on an antibody, e.g., a "minibody" scaffold created by deleting three beta strands from a heavy chain variable domain of a monoclonal antibody (see, e.g., Tramontano et al., 1994, J Mol. Recognit. 7:9; and Martin et al., 1994, EMBO J. 13:5303-5309). The "minibody" can be used to present two hypervariable loops. In embodiments, the scaffold domain is a V-like domain (see, e.g., Coia et al. WO 99/45110) or a domain derived from tendamistatin, which is a 74 residue, six-strand beta sheet sandwich held together by two disulfide bonds (see, e.g., McConnell and Hoess, 1995, J Mol. Biol. 250:460). For example, the loops of tendamistatin can be modified (e.g., using CDRs or hypervariable loops) or varied, e.g., to select domains that bind to a marker/antigen/cell described herein. Another exemplary scaffold domain is a beta-sandwich structure derived from the extracellular domain of CTLA-4 (see, e.g., WO 00/60070).

Other exemplary scaffold domains include but are not limited to T-cell receptors; MHC proteins; extracellular domains (e.g., fibronectin Type III repeats, EGF repeats); protease inhibitors (e.g., Kunitz domains, ecotin, BPTI, and so forth); TPR repeats; trifoil structures; zinc finger domains; DNA-binding proteins; particularly monomeric DNA binding proteins; RNA binding proteins; enzymes, e.g., proteases (particularly inactivated proteases), RNase; chaperones, e.g., thioredoxin, and heat shock proteins; and intracellular signaling domains (such as SH2 and SH3 domains). See, e.g., US 20040009530 and U.S. Pat. No. 7,501,121, incorporated herein by reference.

In embodiments, a scaffold domain is evaluated and chosen, e.g., by one or more of the following criteria: (1) amino acid sequence, (2) sequences of several homologous domains, (3) 3-dimensional structure, and/or (4) stability data over a range of pH, temperature, salinity, organic solvent, oxidant concentration. In embodiments, the scaffold domain is a small, stable protein domain, e.g., a protein of less than 100, 70, 50, 40 or 30 amino acids. The domain may include one or more disulfide bonds or may chelate a metal, e.g., zinc.

Antibody-Based Fusions

A variety of formats can be generated which contain additional binding entities attached to the N or C terminus of antibodies. These fusions with single chain or disulfide stabilized Fvs or Fabs result in the generation of tetravalent molecules with bivalent binding specificity for each antigen. Combinations of scFvs and scFabs with IgGs enable the production of molecules which can recognize three or more different antigens.

Antibody-Fab Fusion

Antibody-Fab Fusions are Bispecific Antibodies Comprising a Traditional Antibody to a first target and a Fab to a second target fused to the C terminus of the antibody heavy chain. Commonly the antibody and the Fab will have a common light chain. Antibody fusions can be produced by (1) engineering the DNA sequence of the target fusion, and (2) transfecting the target DNA into a suitable host cell to express the fusion protein. It seems like the antibody-scFv fusion may be linked by a (Gly)-Ser linker between the C-terminus of the CH3 domain and the N-terminus of the scFv, as described by Coloma, J. et al. (1997) *Nature Biotech* 15:159.

Antibody-scFv Fusion

Antibody-scFv Fusions are bispecific antibodies comprising a traditional antibody and a scFv of unique specificity fused to the C terminus of the antibody heavy chain. The scFv can be fused to the C terminus through the Heavy Chain of the scFv either directly or through a linker peptide. Antibody fusions can be produced by (1) engineering the DNA sequence of the target fusion, and (2) transfecting the target DNA into a suitable host cell to express the fusion protein. It seems like the antibody-scFv fusion may be linked by a (Gly)-Ser linker between the C-terminus of the CH3 domain and the N-terminus of the scFv, as described by Coloma, J. et al. (1997) *Nature Biotech* 15:159.

Variable Domain Immunoglobulin DVD

A related format is the dual variable domain immunoglobulin (DVD), which are composed of VH and VL domains of a second specificity place upon the N termini of the V domains by shorter linker sequences.

Other exemplary multispecific antibody formats include, e.g., those described in the following US20160114057A1, US20130243775A1, US20140051833, US20130022601, US20150017187A1, US20120201746A1, US20150133638A1, US20130266568A1, US20160145340A1, WO2015127158A1, US20150203591A1, US20140322221A1, US20130303396A1, US20110293613, US20130017200A1, US20160102135A1, WO2015197598A2, WO2015197582A1, U.S. Pat. No. 9,359,437, US20150018529, WO2016115274A1, WO2016087416A1, US20080069820A1, U.S. Pat. Nos. 9,145,588B, 7,919,257, and US20150232560A1. Exemplary multispecific molecules utilizing a full antibody-Fab/scFab format include those described in the following, U.S. Pat. No. 9,382,323B2, US20140072581A1, US20140308285A1, US20130165638A1, US20130267686A1, US20140377269A1, U.S. Pat. No. 7,741,446B2, and WO1995009917A1. Exemplary multispecific molecules utilizing a domain exchange format include those described in the following, US20150315296A1, WO2016087650A1, US20160075785A1, WO2016016299A1, US20160130347A1, US20150166670, U.S. Pat. No. 8,703, 132B2, US20100316645, U.S. Pat. No. 8,227,577B2, US20130078249.

Fc-Containing Entities (Mini-Antibodies)

Fc-containing entities, also known as mini-antibodies, can be generated by fusing scFv to the C-termini of constant heavy region domain 3 (CH3-scFv) and/or to the hinge region (scFv-hinge-Fc) of an antibody with a different specificity. Trivalent entities can also be made which have disulfide stabilized variable domains (without peptide linker) fused to the C-terminus of CH3 domains of IgGs.

Fc-Containing Multispecific Molecules

In some embodiments, the multispecific molecules disclosed herein includes an immunoglobulin constant region (e.g., an Fc region). Exemplary Fc regions can be chosen from the heavy chain constant regions of IgG1, IgG2, IgG3 or IgG4; more particularly, the heavy chain constant region of human IgG1, IgG2, IgG3, or IgG4.

In some embodiments, the immunoglobulin chain constant region (e.g., the Fc region) is altered, e.g., mutated, to increase or decrease one or more of: Fc receptor binding, antibody glycosylation, the number of cysteine residues, effector cell function, or complement function.

In other embodiments, an interface of a first and second immunoglobulin chain constant regions (e.g., a first and a second Fc region) is altered, e.g., mutated, to increase or decrease dimerization, e.g., relative to a non-engineered interface, e.g., a naturally-occurring interface. For example, dimerization of the immunoglobulin chain constant region (e.g., the Fc region) can be enhanced by providing an Fc interface of a first and a second Fc region with one or more of: a paired protuberance-cavity ("knob-in-a hole"), an electrostatic interaction, or a strand-exchange, such that a greater ratio of heteromultimer to homomultimer forms, e.g., relative to a non-engineered interface.

In some embodiments, the multispecific molecules include a paired amino acid substitution at a position chosen from one or more of 347, 349, 350, 351, 366, 368, 370, 392, 394, 395, 397, 398, 399, 405, 407, or 409, e.g., of the Fc region of human IgG1 For example, the immunoglobulin chain constant region (e.g., Fc region) can include a paired an amino acid substitution chosen from: T366S, L368A, or Y407V (e.g., corresponding to a cavity or hole), and T366W (e.g., corresponding to a protuberance or knob).

In other embodiments, the multifunctional molecule includes a half-life extender, e.g., a human serum albumin or an antibody molecule to human serum albumin.

Heterodimerized Antibody Molecules & Methods of Making

Various methods of producing multispecific antibodies have been disclosed to address the problem of incorrect heavy chain pairing. Exemplary methods are described below.

Exemplary multispecific antibody formats and methods of making said multispecific antibodies are also disclosed in e.g., Speiss et al. Molecular Immunology 67 (2015) 95-106; and Klein et al mAbs 4:6, 653-663; November/December 2012; the entire contents of each of which are incorporated by reference herein.

Heterodimerized bispecific antibodies are based on the natural IgG structure, wherein the two binding arms recognize different antigens. IgG derived formats that enable defined monovalent (and simultaneous) antigen binding are generated by forced heavy chain heterodimerization, combined with technologies that minimize light chain mispairing (e.g., common light chain). Forced heavy chain heterodimerization can be obtained using, e.g., knob-in-hole OR strand exchange engineered domains (SEED).

Knob-in-Hole

Knob-in-Hole as described in U.S. Pat. Nos. 5,731,116, 7,476,724 and Ridgway, J. et al. (1996) Prot. Engineering 9(7): 617-621, broadly involves: (1) mutating the CH3 domain of one or both antibodies to promote heterodimerization; and (2) combining the mutated antibodies under conditions that promote heterodimerization. "Knobs" or "protuberances" are typically created by replacing a small amino acid in a parental antibody with a larger amino acid (e.g., T366Y or T366W); "Holes" or "cavities" are created by replacing a larger residue in a parental antibody with a smaller amino acid (e.g., Y407T, T366S, L368A and/or Y407V).

For bispecific antibodies including an Fc domain, introduction of specific mutations into the constant region of the heavy chains to promote the correct heterodimerization of the Fc portion can be utilized. Several such techniques are reviewed in Klein et al. (mAbs (2012) 4:6, 1-11), the contents of which are incorporated herein by reference in their entirety. These techniques include the "knobs-into-holes" (KiH) approach which involves the introduction of a bulky residue into one of the CH3 domains of one of the antibody heavy chains. This bulky residue fits into a complementary "hole" in the other CH3 domain of the paired heavy chain so as to promote correct pairing of heavy chains (see e.g., U.S. Pat. No. 7,642,228).

Exemplary KiH mutations include S354C, T366W in the "knob" heavy chain and Y349C, T366S, L368A, Y407V in the "hole" heavy chain. Other exemplary KiH mutations are provided in Table 1, with additional optional stabilizing Fc cysteine mutations.

TABLE 1

Exemplary Fc KiH mutations and optional Cysteine mutations

| Position | Knob Mutation | Hole Mutation |
| --- | --- | --- |
| T366 | T366W | T366S |
| L368 | — | L368A |
| Y407 | — | Y407V |

Additional Cysteine Mutations to form a stabilizing disulfide bridge

| Position | Knob CH3 | Hole CH3 |
| --- | --- | --- |
| S354 | S354C | — |
| Y349 | — | Y349C |

Other Fc mutations are provided by Igawa and Tsunoda who identified 3 negatively charged residues in the CH3 domain of one chain that pair with three positively charged residues in the CH3 domain of the other chain. These specific charged residue pairs are: E356-K439, E357-K370, D399-K409 and vice versa. By introducing at least two of the following three mutations in chain A: E356K, E357K and D399K, as well as K370E, K409D, K439E in chain B, alone or in combination with newly identified disulfide bridges, they were able to favor very efficient heterodimerization while suppressing homodimerization at the same time (Martens T et al. A novel one-armed antic-Met antibody inhibits glioblastoma growth in vivo. Clin Cancer Res 2006; 12:6144-52; PMID:17062691). Xencor defined 41 variant pairs based on combining structural calculations and sequence information that were subsequently screened for maximal heterodimerization, defining the combination of S364H, F405A (HA) on chain A and Y349T, T394F on chain B (TF) (Moore G L et al. A novel bispecific antibody format enables simultaneous bivalent and monovalent co-engagement of distinct target antigens. MAbs 2011; 3:546-57; PMID: 22123055).

Other exemplary Fc mutations to promote heterodimerization of multispecific antibodies include those described in the following references, the contents of each of which is incorporated by reference herein, WO2016071377A1, US20140079689A1, US20160194389A1, US20160257763, WO2016071376A2, WO2015107026A1, WO2015107025A1, WO2015107015A1, US20150353636A1, US20140199294A1, U.S. Pat. No. 7,750,128B2, US20160229915A1, US20150344570A1, U.S. Pat. No. 8,003,774A1, US20150337049A1, US20150175707A1, US20140242075A1, US20130195849A1, US20120149876A1, US20140200331A1, U.S. Pat. Nos. 9,309,311B2, 8,586,713, US20140037621A1, US20130178605A1, US20140363426A1, US20140051835A1 and US20110054151A1.

Stabilizing cysteine mutations have also been used in combination with KiH and other Fc heterodimerization promoting variants, see e.g., U.S. Pat. No. 7,183,076. Other exemplary cysteine modifications include, e.g., those disclosed in US20140348839A1, U.S. Pat. Nos. 7,855,275B2, and 9,000,130B2.

Strand Exchange Engineered Domains (SEED)

Heterodimeric Fc platform that support the design of bispecific and asymmetric fusion proteins by devising strand-exchange engineered domain (SEED) C(H)3 heterodimers are known. These derivatives of human IgG and IgA C(H)3 domains create complementary human SEED C(H)3 heterodimers that are composed of alternating segments of human IgA and IgG C(H)3 sequences. The resulting pair of SEED C(H)3 domains preferentially associates to form heterodimers when expressed in mammalian cells. SEEDbody (Sb) fusion proteins consist of [IgG1 hinge]-C (H)2-[SEED C(H)3], that may be genetically linked to one or more fusion partners (see e.g., Davis J H et al. SEEDbodies: fusion proteins based on strand exchange engineered domain (SEED) CH3 heterodimers in an Fc analogue platform for asymmetric binders or immunofusions and bispecific antibodies. Protein Eng Des Sel 2010; 23:195-202; PMID:20299542 and U.S. Pat. No. 8,871,912. The contents of each of which are incorporated by reference herein).

Duobody

"Duobody" technology to produce bispecific antibodies with correct heavy chain pairing are known. The DuoBody technology involves three basic steps to generate stable bispecific human IgG1 antibodies in a post-production exchange reaction. In a first step, two IgG1s, each containing single matched mutations in the third constant (CH3) domain, are produced separately using standard mammalian recombinant cell lines. Subsequently, these IgG1 antibodies are purified according to standard processes for recovery and purification. After production and purification (post-production), the two antibodies are recombined under tailored laboratory conditions resulting in a bispecific antibody product with a very high yield (typically >95%) (see e.g., Labrijn et al, PNAS 2013; 110(13):5145-5150 and Labrijn et al. Nature Protocols 2014; 9(10):2450-63, the contents of each of which are incorporated by reference herein).

Electrostatic Interactions

Methods of making multispecific antibodies using CH3 amino acid changes with charged amino acids such that homodimer formation is electrostatically unfavorable are disclosed. EP1870459 and WO 2009089004 describe other strategies for favoring heterodimer formation upon co-expression of different antibody domains in a host cell. In these methods, one or more residues that make up the heavy chain constant domain 3 (CH3), CH3-CH3 interfaces in both CH3 domains are replaced with a charged amino acid such that homodimer formation is electrostatically unfavorable and heterodimerization is electrostatically favorable. Additional methods of making multispecific molecules using electrostatic interactions are described in the following references, the contents of each of which is incorporated by reference herein, include US20100015133, U.S. Pat. Nos. 8,592, 562B2, 9,200,060B2, US20140154254A1, and U.S. Pat. No. 9,358,286A1.

Common Light Chain

Light chain mispairing needs to be avoided to generate homogenous preparations of bispecific IgGs. One way to achieve this is through the use of the common light chain principle, i.e. combining two binders that share one light chain but still have separate specificities. An exemplary method of enhancing the formation of a desired bispecific antibody from a mixture of monomers is by providing a common variable light chain to interact with each of the heteromeric variable heavy chain regions of the bispecific antibody. Compositions and methods of producing bispecific antibodies with a common light chain as disclosed in, e.g., U.S. Pat. No. 7,183,076B2, US20110177073A1, EP2847231A1, WO2016079081A1, and EP3055329A1, the contents of each of which is incorporated by reference herein.

CrossMab

Another option to reduce light chain mispairing is the CrossMab technology which avoids non-specific L chain mispairing by exchanging CH1 and CL domains in the Fab of one half of the bispecific antibody. Such crossover variants retain binding specificity and affinity, but make the two arms so different that L chain mispairing is prevented. The CrossMab technology (as reviewed in Klein et al. Supra) involves domain swapping between heavy and light chains so as to promote the formation of the correct pairings. Briefly, to construct a bispecific IgG-like CrossMab antibody that could bind to two antigens by using two distinct light chain-heavy chain pairs, a two-step modification process is applied. First, a dimerization interface is engineered into the C-terminus of each heavy chain using a heterodimerization approach, e.g., Knob-into-hole (KiH) technology, to ensure that only a heterodimer of two distinct heavy chains from one antibody (e.g., Antibody A) and a second antibody (e.g., Antibody B) is efficiently formed. Next, the constant heavy 1 (CH1) and constant light (CL) domains of one antibody are exchanged (Antibody A), keeping the variable heavy (VH) and variable light (VL) domains consistent. The exchange of the CH1 and CL domains ensured that the modified antibody (Antibody A) light chain would only efficiently dimerize with the modified antibody (antibody A) heavy chain, while the unmodified antibody (Antibody B) light chain would only efficiently dimerize with the unmodified antibody (Antibody B) heavy chain; and thus only the desired bispecific CrossMab would be efficiently formed (see e.g., Cain, C. SciBX 4(28); doi:10.1038/scibx.2011.783, the contents of which are incorporated by reference herein).

Common Heavy Chain

An exemplary method of enhancing the formation of a desired bispecific antibody from a mixture of monomers is by providing a common variable heavy chain to interact with each of the heteromeric variable light chain regions of the bispecific antibody. Compositions and methods of producing bispecific antibodies with a common heavy chain are disclosed in, e.g., US20120184716, US20130317200, and US20160264685A1, the contents of each of which is incorporated by reference herein.

Amino Acid Modifications

Alternative compositions and methods of producing multispecific antibodies with correct light chain pairing include various amino acid modifications. For example, Zymeworks describes heterodimers with one or more amino acid modifications in the CH1 and/or CL domains, one or more amino acid modifications in the VH and/or VL domains, or a combination thereof, which are part of the interface between the light chain and heavy chain and create preferential pairing between each heavy chain and a desired light chain such that when the two heavy chains and two light chains of the heterodimer pair are co-expressed in a cell, the heavy chain of the first heterodimer preferentially pairs with one of the light chains rather than the other (see e.g., WO2015181805). Other exemplary methods are described in WO2016026943 (Argen-X), US20150211001, US20140072581A1, US20160039947A1, and US20150368352.

Lambda/Kappa Formats

Multispecific molecules (e.g., multispecific antibody molecules) that include the lambda light chain polypeptide and a kappa light chain polypeptides, can be used to allow for heterodimerization. Methods for generating bispecific antibody molecules comprising the lambda light chain polypeptide and a kappa light chain polypeptides are disclosed in PCT/US17/53053 filed on Sep. 22, 2017, incorporated herein by reference in its entirety.

In embodiments, the multispecific molecules includes a multispecific antibody molecule, e.g., an antibody molecule comprising two binding specificities, e.g., a bispecific antibody molecule. The multispecific antibody molecule includes:

a lambda light chain polypeptide 1 (LLCP1) specific for a first epitope;

a heavy chain polypeptide 1 (HCP1) specific for the first epitope;

a kappa light chain polypeptide 2 (KLCP2) specific for a second epitope; and a heavy chain polypeptide 2 (HCP2) specific for the second epitope.

"Lambda light chain polypeptide 1 (LLCP1)", as that term is used herein, refers to a polypeptide comprising sufficient light chain (LC) sequence, such that when combined with a cognate heavy chain variable region, can mediate specific binding to its epitope and complex with an HCP1. In an embodiment it comprises all or a fragment of a CH1 region. In an embodiment, an LLCP1 comprises LC-CDR1, LC-CDR2, LC-CDR3, FR1, FR2, FR3, FR4, and CH1, or sufficient sequence therefrom to mediate specific binding of its epitope and complex with an HCP1. LLCP1, together with its HCP1, provide specificity for a first epitope (while KLCP2, together with its HCP2, provide specificity for a second epitope). As described elsewhere herein, LLCP1 has a higher affinity for HCP1 than for HCP2.

"Kappa light chain polypeptide 2 (KLCP2)", as that term is used herein, refers to a polypeptide comprising sufficient light chain (LC) sequence, such that when combined with a cognate heavy chain variable region, can mediate specific binding to its epitope and complex with an HCP2. In an embodiments it comprises all or a fragment of a CH1 region. In an embodiment, a KLCP2 comprises LC-CDR1, LC-CDR2, LC-CDR3, FR1, FR2, FR3, FR4, and CH1, or sufficient sequence therefrom to mediate specific binding of its epitope and complex with an HCP2. KLCP2, together with its HCP2, provide specificity for a second epitope (while LLCP1, together with its HCP1, provide specificity for a first epitope).

"Heavy chain polypeptide 1 (HCP1)", as that term is used herein, refers to a polypeptide comprising sufficient heavy chain (HC) sequence, e.g., HC variable region sequence, such that when combined with a cognate LLCP1, can mediate specific binding to its epitope and complex with an HCP1. In an embodiments it comprises all or a fragment of a CH1 region. In an embodiment, it comprises all or a fragment of a CH2 and/or CH3 region. In an embodiment an HCP1 comprises HC-CDR1, HC-CDR2, HC-CDR3, FR1, FR2, FR3, FR4, CH1, CH2, and CH3, or sufficient sequence therefrom to: (i) mediate specific binding of its epitope and complex with an LLCP1, (ii) to complex preferentially, as described herein to LLCP1 as opposed to KLCP2; and (iii) to complex preferentially, as described herein, to an HCP2, as opposed to another molecule of HCP1. HCP1, together with its LLCP1, provide specificity for a first epitope (while KLCP2, together with its HCP2, provide specificity for a second epitope).

"Heavy chain polypeptide 2 (HCP2)", as that term is used herein, refers to a polypeptide comprising sufficient heavy chain (HC) sequence, e.g., HC variable region sequence, such that when combined with a cognate LLCP1, can mediate specific binding to its epitope and complex with an HCP1. In an embodiments it comprises all or a fragment of a CH1 region. In an embodiments it comprises all or a fragment of a CH2 and/or CH3 region. In an embodiment an HCP1 comprises HC-CDR1, HC-CDR2, HC-CDR3, FR1, FR2, FR3, FR4, CH1, CH2, and CH3, or sufficient sequence therefrom to: (i) mediate specific binding of its epitope and complex with an KLCP2, (ii) to complex preferentially, as described herein to KLCP2 as opposed to LLCP1; and (iii) to complex preferentially, as described herein, to an HCP1, as opposed to another molecule of HCP2. HCP2, together with its KLCP2, provide specificity for a second epitope (while LLCP1, together with its HCP1, provide specificity for a first epitope).

In some embodiments of the multispecific antibody molecule disclosed herein:

LLCP1 has a higher affinity for HCP1 than for HCP2; and/or

KLCP2 has a higher affinity for HCP2 than for HCP1.

In embodiments, the affinity of LLCP1 for HCP1 is sufficiently greater than its affinity for HCP2, such that under preselected conditions, e.g., in aqueous buffer, e.g., at pH 7, in saline, e.g., at pH 7, or under physiological conditions, at least 75, 80, 90, 95, 98, 99, 99.5, or 99.9% of the multispecific antibody molecule molecules have a LLCP1 complexed, or interfaced with, a HCP1.

In some embodiments of the multispecific antibody molecule disclosed herein:

the HCP1 has a greater affinity for HCP2, than for a second molecule of HCP1; and/or the HCP2 has a greater affinity for HCP1, than for a second molecule of HCP2.

In embodiments, the affinity of HCP1 for HCP2 is sufficiently greater than its affinity for a second molecule of HCP1, such that under preselected conditions, e.g., in aqueous buffer, e.g., at pH 7, in saline, e.g., at pH 7, or under physiological conditions, at least 75%, 80, 90, 95, 98, 99 99.5 or 99.9% of the multispecific antibody molecule molecules have a HCP1 complexed, or interfaced with, a HCP2.

In another aspect, disclosed herein is a method for making, or producing, a multispecific antibody molecule. The method includes:

(i) providing a first heavy chain polypeptide (e.g., a heavy chain polypeptide comprising one, two, three or all of a first heavy chain variable region (first VH), a first CH1, a first heavy chain constant region (e.g., a first CH2, a first CH3, or both));

(ii) providing a second heavy chain polypeptide (e.g., a heavy chain polypeptide comprising one, two, three or all of a second heavy chain variable region (second VH), a second CH1, a second heavy chain constant region (e.g., a second CH2, a second CH3, or both));

(iii) providing a lambda chain polypeptide (e.g., a lambda light variable region (VLλ), a lambda light constant chain (CLλ), or both) that preferentially associates with the first heavy chain polypeptide (e.g., the first VH); and (iv) providing a kappa chain polypeptide (e.g., a kappa light variable region (VLκ), a kappa light constant chain (CLκ), or both) that preferentially associates with the second heavy chain polypeptide (e.g., the second VH), under conditions where (i)-(iv) associate.

In embodiments, the first and second heavy chain polypeptides form an Fc interface that enhances heterodimerization.

In embodiments, (i)-(iv) (e.g., nucleic acid encoding (i)-(iv)) are introduced in a single cell, e.g., a single mammalian cell, e.g., a CHO cell. In embodiments, (i)-(iv) are expressed in the cell.

In embodiments, (i)-(iv) (e.g., nucleic acid encoding (i)-(iv)) are introduced in different cells, e.g., different mammalian cells, e.g., two or more CHO cell. In embodiments, (i)-(iv) are expressed in the cells.

In one embodiments, the method further comprises purifying a cell-expressed antibody molecule, e.g., using a lambda- and/or kappa-specific purification, e.g., affinity chromatography.

In embodiments, the method further comprises evaluating the cell-expressed multispecific antibody molecule. For example, the purified cell-expressed multispecific antibody molecule can be analyzed by techniques known in the art, include mass spectrometry. In one embodiment, the purified cell-expressed antibody molecule is cleaved, e.g., digested with papain to yield the Fab moieties and evaluated using mass spectrometry.

In embodiments, the method produces correctly paired kappa/lambda multispecific, e.g., bispecific, antibody molecules in a high yield, e.g., at least 75%, 80, 90, 95, 98, 99 99.5 or 99.9%.

In other embodiments, the multispecific, e.g., a bispecific, antibody molecule that includes:

(i) a first heavy chain polypeptide (HCP1) (e.g., a heavy chain polypeptide comprising one, two, three or all of a first heavy chain variable region (first VH), a first CH1, a first heavy chain constant region (e.g., a first CH2, a first CH3, or both)), e.g., wherein the HCP1 binds to a first epitope;

(ii) a second heavy chain polypeptide (HCP2) (e.g., a heavy chain polypeptide comprising one, two, three or all of a second heavy chain variable region (second VH), a second CH1, a second heavy chain constant region (e.g., a second CH2, a second CH3, or both)), e.g., wherein the HCP2 binds to a second epitope;

(iii) a lambda light chain polypeptide (LLCP1) (e.g., a lambda light variable region (VL1), a lambda light constant chain (CL1), or both) that preferentially associates with the first heavy chain polypeptide (e.g., the first VH), e.g., wherein the LLCP1 binds to a first epitope; and (iv) a kappa light chain polypeptide (KLCP2) (e.g., a lambda light variable region (VLk), a lambda light constant chain (CLk), or both) that preferentially associates with the second heavy chain polypeptide (e.g., the second VH), e.g., wherein the KLCP2 binds to a second epitope.

In embodiments, the first and second heavy chain polypeptides form an Fc interface that enhances heterodimerization. In embodiments, the multispecific antibody molecule has a first binding specificity that includes a hybrid VL1-CL1 heterodimerized to a first heavy chain variable region connected to the Fc constant, CH2-CH3 domain (having a knob modification) and a second binding specificity that includes a hybrid VLk-CLk heterodimerized to a second heavy chain variable region connected to the Fc constant, CH2-CH3 domain (having a hole modification).

TRBC1 and TRBC2 Antigen Binding Domains

The present disclosure provides, inter alia, antibody molecules, e.g., multispecific (e.g., bi-, tri-, tetra-specific) or multifunctional molecules, that include, e.g., are engineered to contain, one or more antigen binding domains that bind to a tumor antigen on a lymphoma cell (e.g., T cell). In some embodiments, the tumor antigen comprises a T cell receptor comprising TRBC1 or TRBC2. In some embodiments, the antigen binding domain preferentially binds to a T cell receptor comprising TRBC1 (e.g., relative to a T cell receptor comprising TRBC2). In some embodiments, the antigen binding domain preferentially binds to a T cell receptor comprising TRBC2 (e.g., relative to a T cell receptor comprising TRBC1). In some embodiments, the multifunctional molecules include, e.g., are engineered to contain, one or more antigen binding domains that selectively target lymphocytes expressing TRBC1 or TRBC2. In some embodiments, the antigen binding domain selectively targets lymphocytes expressing a T cell receptor comprising TRBC1 or a T cell receptor comprising TRBC2.

T cell receptors (TCRs) are receptors found on the surface of lymphocytes, specifically on T lymphocytes (T cells). TCRs are responsible for recognizing antigen fragments presented by major histocompatibility complex (MHC) molecules on other immune cells (e.g., B cells) by signaling through associated CD3 and activating the T cell. The vast majority of TCRs in humans are heterodimers comprising an alpha chain and a beta chain. Both alpha and beta chains of TCR comprise variable and constant regions. The variable regions of the alpha and beta chain are encoded by distinct DNA elements (V, D, and J elements for beta chain; V and J elements for the alpha chain). Recombination between these elements produces in large part the variation in antigen binding specificity of TCRs. The TCR beta chain constant region is selected from two different domains, beta constant domain 1 and beta constant domain 2. Without wishing to be bound by theory, it is thought that the majority of TCRs comprising a beta chain comprise a beta chain comprising beta constant domain 1 or beta constant domain 2, but not both constant domain 1 and constant domain 2.

In some embodiments, the multifunctional or multispecific molecules or antibody molecules of the present application comprise an antigen binding domain that binds to a tumor antigen on a lymphoma cell (e.g., a T cell), e.g., a T cell receptor comprising TRBC1, TRBC1, a T cell receptor comprising TRBC2, or TRBC2. In some embodiments, the multifunctional or multispecific molecules or antibody molecules of the present application comprise an antigen binding domain that selectively targets lymphocytes expressing a T cell receptor comprising TRBC1, TRBC1, a T cell receptor comprising TRBC2, or TRBC2. While it is most typical for a lymphocyte or lymphoma cell presenting a T cell receptor comprising TRBC1 or TRBC2 to be a T cell, cancer causes many disruptions in non-disease expression patterns. Thus, in some embodiments, the lymphoma cell or lymphocyte may not be a T cell. In some embodiments, the lymphoma cell or lymphocyte is a B cell. In some embodiments, the lymphoma cell or lymphocyte is a natural killer cell.

In some embodiments, the antigen binding domain (e.g., first antigen binding domain) comprises any CDR amino acid sequence, framework region (FWR) amino acid sequence, or variable region amino acid sequence of an anti-TRBC1 antibody known in the art. In some embodiments, CDR amino acid sequence, framework region (FWR) amino acid sequence, or variable region amino acid sequence are selected from JOVI.1.

In some embodiments, the antigen binding domain that binds to TRBC1 comprises one or more CDRs (e.g., VHCDR1, VHCDR2, VHCDR3, VLCDR1, VLCDR2, and/or VLCDR3) disclosed in Table 2, Table 6, or Table 3, or a sequence having at least 85%, 90%, 95%, or 99% identity thereto. In some embodiments, the antigen binding domain that binds to TRBC1 comprises one or more framework regions (e.g., VHFWR1, VHFWR2, VHFWR3, VHFWR4, VLFWR1, VLFWR2, VLFWR3, and/or VLFWR4) disclosed in Table 2, Table 6, or Table 3, or a sequence having at least 85%, 90%, 95%, or 99% identity thereto. In some embodiments, the antigen binding domain that binds to TRBC1 comprises a VH and/or a VL disclosed in Table 4, or a sequence having at least 85%, 90%, 95%, or 99% identity thereto. In some embodiments, the antigen binding domain that binds to TRBC1 comprises an amino acid sequence disclosed in Table 5, or a sequence having at least 85%, 90%, 95%, or 99% identity thereto.

In some embodiments, the antigen binding domain that binds to TRBC1 comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3.

In some embodiments, the VHCDR1, VHCDR2, and VHCDR3 comprise the amino acid sequences of SEQ ID NOs: 7346, 7355, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7346, 201, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7354, 201, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7354, 7355, and 202, respectively (or a sequence having at least 85%, 90%, 95%, or 99% identity thereto).

In some embodiments, the VLCDR1, VLCDR2, and VLCDR3 comprise the amino acid sequences of SEQ ID NOs: 223, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 7367, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 223, 7368, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 223, 224, and 7369, respectively (or a sequence having at least 85%, 90%, 95%, or 99% identity thereto). In some embodiments, the VLCDR1, VLCDR2, and VLCDR3 comprise the amino acid sequences of SEQ ID NOs: 7367, 7368, and 7369, respectively (or a sequence having at least 85%, 90%, 95%, or 99% identity thereto).

In some embodiments, the VHCDR1, VHCDR2, VHCDR3, VLCDR1, VLCDR2, and VLCDR3 comprise the amino acid sequences of SEQ ID NOs: 7346, 7355, 202, 223, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7346, 201, 202, 223, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of: SEQ ID NOs: 7346, 7355, 202, 7367, 224, and 225, respectively (or a sequence having at least 85%, 90%, 95%, or 99% identity thereto); SEQ ID NOs: 7346, 7355, 202, 223, 7368, and 225, respectively (or a sequence having at least 85%, 90%, 95%, or 99% identity thereto); SEQ ID NOs: 7346, 7355, 202, 223, 224, and 7369, respectively (or a sequence having at least 85%, 90%, 95%, or 99% identity thereto); SEQ ID NOs: 7346, 7355, 202, 7367, 7368, and 7369, respectively (or a sequence having at least 85%, 90%, 95%, or 99% identity thereto); SEQ ID NOs: 7346, 201, 202, 7367, 224, and 225, respectively (or a sequence having at least 85%, 90%, 95%, or 99% identity thereto); SEQ ID NOs: 7346, 201, 202, 223, 7368, and 225, respectively (or a sequence having at least 85%, 90%, 95%, or 99% identity thereto); SEQ ID NOs: 7346, 201, 202, 223, 224, and 7369, respectively (or a sequence having at least 85%, 90%, 95%, or 99% identity thereto); SEQ ID NOs: 7346, 201, 202, 7367, 7368, and 7369, respectively (or a sequence having at least 85%, 90%, 95%, or 99% identity thereto); SEQ ID NOs: 7354, 201, 202, 223, 224, and 225, respectively (or a sequence having at least 85%, 90%, 95%, or 99% identity thereto); SEQ ID NOs: 7354, 201, 202, 7367, 224, and 225, respectively (or a sequence having at least 85%, 90%, 95%, or 99% identity thereto); SEQ ID NOs: 7354, 201, 202, 223, 7368, and 225, respectively (or a sequence having at least 85%, 90%, 95%, or 99% identity thereto); SEQ ID NOs: 7354, 201, 202, 223, 224, and 7369, respectively (or a sequence having at least 85%, 90%, 95%, or 99% identity thereto); SEQ ID NOs: 7354, 201, 202, 7367, 7368, and 7369, respectively (or a sequence having at least 85%, 90%, 95%, or 99% identity thereto); SEQ ID NOs: 7354, 7355, 202, 223, 224, and 225, respectively (or a sequence having at least 85%, 90%, 95%, or 99% identity thereto); SEQ ID NOs: 7354, 7355, 202, 7367, 224, and 225, respectively (or a sequence having at least 85%, 90%, 95%, or 99% identity thereto); SEQ ID NOs: 7354, 7355, 202, 223, 7368, and 225, respectively (or a sequence having at least 85%, 90%, 95%, or 99% identity thereto); SEQ ID NOs: 7354, 7355, 202, 223, 224, and 7369, respectively (or a sequence having at least 85%, 90%, 95%, or 99% identity thereto); or SEQ ID NOs: 7354, 7355, 202, 7367, 7368, and 7369, respectively (or a sequence having at least 85%, 90%, 95%, or 99% identity thereto).

In some embodiments, the VH comprises an amino acid sequence selected from the group consisting of SEQ ID NOs: 7351, 253, 250-252, 254, 7343, 7344, 7350, and 7352 (or a sequence having at least 85%, 90%, 95%, or 99% identity thereto) and/or the VL comprises an amino acid sequence selected from the group consisting of SEQ ID NOs: 258, 255-257, 259, 260, and 7357-7360 (or a sequence having at least 85%, 90%, 95%, or 99% identity thereto). In some embodiments, the VH and VL comprise the amino acid sequences of SEQ ID NOs: 7351 and 258, respectively (or a sequence having at least 85%, 90%, 95%, or 99% identity thereto). In some embodiments, the VH and VL comprise the amino acid sequences of SEQ ID NOs: 253 and 258, respectively (or a sequence having at least 85%, 90%, 95%, or 99% identity thereto).

In some embodiments, the antigen binding domain (e.g., first antigen binding domain) that binds to a tumor antigen on a lymphoma cell (e.g., a T cell), e.g., a T cell receptor comprising TRBC1, TRBC1, a T cell receptor comprising TRBC2, or TRBC2 comprises any CDR amino acid sequence, framework region (FWR) amino acid sequence, or variable region amino acid sequence Tables 2-6. In some embodiments, the antigen binding domain (e.g., first antigen binding domain) that binds to a tumor antigen on a lymphoma cell (e.g., a T cell), e.g., a T cell receptor comprising TRBC1, TRBC1, a T cell receptor comprising TRBC2, or TRBC2 comprises heavy and/or light chain amino acid sequences of Table 5. In some embodiments, the antigen binding domain (e.g., first antigen binding domain) that selectively targets lymphocytes expressing a T cell receptor comprising TRBC1, TRBC1, a T cell receptor comprising TRBC2, or TRBC2 comprises any CDR amino acid sequence, framework region (FWR) amino acid sequence, or variable region amino acid sequence disclosed in Tables 2-6. In some embodiments, the antigen binding domain (e.g., first antigen binding domain) that selectively targets lymphocytes expressing a T cell receptor comprising TRBC1, TRBC1, a T cell receptor comprising TRBC2, or TRBC2 comprises heavy and/or light chain amino acid sequences of Table 5. An antigen binding domain that binds to a tumor antigen comprising TRBC1 or selectively targets lymphocytes expressing TRBC1 may be said to target TRBC1 (i.e., a TRBC1-targeting antigen binding domain). An antigen binding domain that binds to a tumor antigen comprising TRBC2 or selectively targets lymphocytes expressing TRBC2 may be said to target TRBC2 (i.e., a TRBC2-targeting antigen binding domain).

In some embodiments, the antigen binding domain that targets TRBC1 comprises a VH comprising a heavy chain complementarity determining region 1 (VHCDR1) amino acid sequence of SEQ ID NO: 200 (or a sequence with no more than 1, 2, 3, or 4 mutations, e.g., substitutions, additions, or deletions), a VHCDR2 amino acid sequence of SEQ ID NO: 201 (or a sequence with no more than 1, 2, 3, or 4 mutations, e.g., substitutions, additions, or deletions), and/or a VHCDR3 amino acid sequence of SEQ ID NO: 202 (or a sequence with no more than 1, 2, 3, or 4 mutations, e.g., substitutions, additions, or deletions). In some embodiments, the TRBC1 antigen binding domain comprises a VH comprising a VHCDR1 amino acid sequence of SEQ ID NO: 200, a VHCDR2 amino acid sequence of SEQ ID NO: 201, and/or a VHCDR3 amino acid sequence of SEQ ID NO: 202.

In some embodiments, the antigen binding domain that targets TRBC1 comprises a VL comprising a light chain complementarity determining region 1 (VLCDR1) amino acid sequence of SEQ ID NO: 223 (or a sequence with no more than 1, 2, 3, or 4 mutations, e.g., substitutions, additions, or deletions), a VLCDR2 amino acid sequence of SEQ ID NO: 224 (or a sequence with no more than 1, 2, 3, or 4 mutations, e.g., substitutions, additions, or deletions), and/or a VLCDR3 amino acid sequence of SEQ ID NO: 225 (or a sequence with no more than 1, 2, 3, or 4 mutations, e.g., substitutions, additions, or deletions). In some embodiments, the antigen binding domain that targets TRBC1 comprises a VL comprising a VLCDR1 amino acid sequence of SEQ ID NO: 223, a VLCDR2 amino acid sequence of SEQ ID NO: 224, and a VLCDR3 amino acid sequence of SEQ ID NO: 225.

In some embodiments, the antigen binding domain that targets TRBC1 comprises a VH comprising a heavy chain framework region 1 (VHFWR1) amino acid sequence of SEQ ID NO: 203, a VHFWR2 amino acid sequence of SEQ ID NO: 204, a VHFWR3 amino acid sequence of SEQ ID NO: 205, and/or a VHFWR4 amino acid sequence of SEQ ID NO: 206.

In some embodiments, the antigen binding domain that targets TRBC1 comprises a VL comprising a light chain framework region 1 (VLFWR1) amino acid sequence of SEQ ID NO: 226, a VLFWR2 amino acid sequence of SEQ ID NO: 227, a VLFWR3 amino acid sequence of SEQ ID NO: 228, and/or a VLFWR4 amino acid sequence of SEQ ID NO: 229.

In some embodiments, the antigen binding domain that targets TRBC1 comprises a VH comprising a VHFWR1 amino acid sequence of SEQ ID NO: 203 (or a sequence with no more than 1, 2, 3, 4, 5, or 6 mutations, e.g., substitutions, additions, or deletions, therefrom), a VHFWR2 amino acid sequence of SEQ ID NO: 204 (or a sequence with no more than 1, 2, 3, 4, 5, or 6 mutations, e.g., substitutions, additions, or deletions, therefrom), a VHFWR3 amino acid sequence of SEQ ID NO: 205 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 206.

In some embodiments, the antigen binding domain that targets TRBC1 comprises a VL comprising a VLFWR1 amino acid sequence of SEQ ID NO: 226 (or a sequence with no more than 1, 2, or 3 mutations, e.g., substitutions, additions, or deletions), a VLFWR2 amino acid sequence of SEQ ID NO: 227 (or a sequence with no more than 1 mutation, e.g., substitution, addition, or deletion), a VLFWR3 amino acid sequence of SEQ ID NO: 228 (or a sequence with no more than 1 mutation, e.g., substitution, addition, or deletion), and/or a VLFWR4 amino acid sequence of SEQ ID NO: 229.

In some embodiments, the antigen binding domain that targets TRBC1 comprises a VH comprising a heavy chain framework region 1 (VHFWR1) amino acid sequence of SEQ ID NO: 207, a VHFWR2 amino acid sequence of SEQ ID NO: 208, a VHFWR3 amino acid sequence of SEQ ID NO: 209, and/or a VHFWR4 amino acid sequence of SEQ ID NO: 210.

In some embodiments, the antigen binding domain that targets TRBC1 comprises a VH comprising a VHFWR1 amino acid sequence of SEQ ID NO: 207 (or a sequence with no more than 1, 2, 3, 4, 5, or 6 mutations, e.g., substitutions, additions, or deletions, therefrom), a VHFWR2 amino acid sequence of SEQ ID NO: 208 (or a sequence with no more than 1, 2, 3, 4, 5, or 6 mutations, e.g., substitutions, additions, or deletions, therefrom), a VHFWR3 amino acid sequence of SEQ ID NO: 209 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 210.

In some embodiments, the antigen binding domain that targets TRBC1 comprises a VH comprising a heavy chain framework region 1 (VHFWR1) amino acid sequence of SEQ ID NO: 211, a VHFWR2 amino acid sequence of SEQ ID NO: 212, a VHFWR3 amino acid sequence of SEQ ID NO: 213, and/or a VHFWR4 amino acid sequence of SEQ ID NO.: 214.

In some embodiments, the antigen binding domain that targets TRBC1 comprises a VH comprising a VHFWR1 amino acid sequence of SEQ ID NO: 211 (or a sequence with no more than 1, 2, 3, 4, 5, or 6 mutations, e.g., substitutions, additions, or deletions, therefrom), a VHFWR2 amino acid sequence of SEQ ID NO: 212 (or a sequence with no more than 1, 2, 3, 4, 5, or 6 mutations, e.g., substitutions, additions, or deletions, therefrom), a VHFWR3 amino acid sequence of SEQ ID NO: 213 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 214.

In some embodiments, the antigen binding domain that targets TRBC1 comprises a VH comprising a heavy chain framework region 1 (VHFWR1) amino acid sequence of SEQ ID NO: 215, a VHFWR2 amino acid sequence of SEQ ID NO: 216, a VHFWR3 amino acid sequence of SEQ ID NO: 217, and/or a VHFWR4 amino acid sequence of SEQ ID NO.: 218.

In some embodiments, the antigen binding domain that targets TRBC1 comprises a VH comprising a VHFWR1 amino acid sequence of SEQ ID NO: 215 (or a sequence with no more than 1, 2, 3, 4, 5, or 6 mutations, e.g., substitutions, additions, or deletions, therefrom), a VHFWR2 amino acid sequence of SEQ ID NO: 216 (or a sequence with no more than 1, 2, 3, 4, 5, or 6 mutations, e.g., substitutions, additions, or deletions, therefrom), a VHFWR3 amino acid sequence of SEQ ID NO: 217 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 218.

In some embodiments, the antigen binding domain that targets TRBC1 comprises a VH comprising a heavy chain framework region 1 (VHFWR1) amino acid sequence of SEQ ID NO: 219, a VHFWR2 amino acid sequence of SEQ ID NO: 220, a VHFWR3 amino acid sequence of SEQ ID NO: 221, and/or a VHFWR4 amino acid sequence of SEQ ID NO.: 222.

In some embodiments, the antigen binding domain that targets TRBC1 comprises a VH comprising a VHFWR1 amino acid sequence of SEQ ID NO: 219 (or a sequence with no more than 1, 2, 3, 4, 5, or 6 mutations, e.g., substitutions, additions, or deletions, therefrom), a VHFWR2 amino acid sequence of SEQ ID NO: 220 (or a sequence with no more than 1, 2, 3, 4, 5, or 6 mutations, e.g., substitutions, additions, or deletions, therefrom), a VHFWR3 amino acid sequence of SEQ ID NO: 221 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 222.

In some embodiments, the antigen binding domain that targets TRBC1 comprises a VL comprising a light chain framework region 1 (VLFWR1) amino acid sequence of SEQ ID NO: 230, a VLFWR2 amino acid sequence of SEQ ID NO: 231, a VLFWR3 amino acid sequence of SEQ ID NO: 232, and/or a VLFWR4 amino acid sequence of SEQ ID NO: 233.

In some embodiments, the antigen binding domain that targets TRBC1 comprises a VL comprising a VLFWR1 amino acid sequence of SEQ ID NO: 230 (or a sequence with no more than 1, 2, or 3 mutations, e.g., substitutions, additions, or deletions), a VLFWR2 amino acid sequence of SEQ ID NO: 231 (or a sequence with no more than 1 mutation, e.g., substitution, addition, or deletion), a VLFWR3 amino acid sequence of SEQ ID NO: 232 (or a sequence with no more than 1 mutation, e.g., substitution, addition, or deletion), and/or a VLFWR4 amino acid sequence of SEQ ID NO: 233.

In some embodiments, the antigen binding domain that targets TRBC1 comprises a VL comprising a light chain framework region 1 (VLFWR1) amino acid sequence of SEQ ID NO: 234, a VLFWR2 amino acid sequence of SEQ ID NO: 235, a VLFWR3 amino acid sequence of SEQ ID NO: 236, and/or a VLFWR4 amino acid sequence of SEQ ID NO: 237.

In some embodiments, the antigen binding domain that targets TRBC1 comprises a VL comprising a VLFWR1 amino acid sequence of SEQ ID NO: 234 (or a sequence with no more than 1, 2, or 3 mutations, e.g., substitutions, additions, or deletions), a VLFWR2 amino acid sequence of SEQ ID NO: 235 (or a sequence with no more than 1 mutation, e.g., substitution, addition, or deletion), a VLFWR3 amino acid sequence of SEQ ID NO: 236 (or a sequence with no more than 1 mutation, e.g., substitution, addition, or deletion), and/or a VLFWR4 amino acid sequence of SEQ ID NO: 237.

In some embodiments, the antigen binding domain that targets TRBC1 comprises a VL comprising a light chain framework region 1 (VLFWR1) amino acid sequence of SEQ ID NO: 238, a VLFWR2 amino acid sequence of SEQ ID NO: 239, a VLFWR3 amino acid sequence of SEQ ID NO: 240, and/or a VLFWR4 amino acid sequence of SEQ ID NO: 241.

In some embodiments, the antigen binding domain that targets TRBC1 comprises a VL comprising a VLFWR1 amino acid sequence of SEQ ID NO: 238 (or a sequence with no more than 1, 2, or 3 mutations, e.g., substitutions, additions, or deletions), a VLFWR2 amino acid sequence of SEQ ID NO: 239 (or a sequence with no more than 1 mutation, e.g., substitution, addition, or deletion), a VLFWR3 amino acid sequence of SEQ ID NO: 240 (or a sequence with no more than 1 mutation, e.g., substitution, addition, or deletion), and/or a VLFWR4 amino acid sequence of SEQ ID NO: 241.

In some embodiments, the antigen binding domain that targets TRBC1 comprises a VL comprising a light chain framework region 1 (VLFWR1) amino acid sequence of SEQ ID NO: 242, a VLFWR2 amino acid sequence of SEQ ID NO: 243, a VLFWR3 amino acid sequence of SEQ ID NO: 244, and/or a VLFWR4 amino acid sequence of SEQ ID NO: 245.

In some embodiments, the antigen binding domain that targets TRBC1 comprises a VL comprising a VLFWR1 amino acid sequence of SEQ ID NO: 242 (or a sequence with no more than 1, 2, or 3 mutations, e.g., substitutions, additions, or deletions), a VLFWR2 amino acid sequence of SEQ ID NO: 243 (or a sequence with no more than 1 mutation, e.g., substitution, addition, or deletion), a VLFWR3 amino acid sequence of SEQ ID NO: 244 (or a sequence with no more than 1 mutation, e.g., substitution, addition, or deletion), and/or a VLFWR4 amino acid sequence of SEQ ID NO: 245.

In some embodiments, the antigen binding domain that targets TRBC1 comprises a VL comprising a light chain framework region 1 (VLFWR1) amino acid sequence of SEQ ID NO: 246, a VLFWR2 amino acid sequence of SEQ ID NO: 247, a VLFWR3 amino acid sequence of SEQ ID NO: 248, and/or a VLFWR4 amino acid sequence of SEQ ID NO: 249.

In some embodiments, the antigen binding domain that targets TRBC1 comprises a VL comprising a VLFWR1 amino acid sequence of SEQ ID NO: 246 (or a sequence with no more than 1, 2, or 3 mutations, e.g., substitutions, additions, or deletions), a VLFWR2 amino acid sequence of SEQ ID NO: 247 (or a sequence with no more than 1 mutation, e.g., substitution, addition, or deletion), a VLFWR3 amino acid sequence of SEQ ID NO: 248 (or a sequence with no more than 1 mutation, e.g., substitution, addition, or deletion), and/or a VLFWR4 amino acid sequence of SEQ ID NO: 249.

In some embodiments, the antigen binding domain that targets TRBC1 comprises a VH comprising the amino acid sequence of SEQ ID NO: 250 (or an amino acid sequence having at least about 77%, 80%, 85%, 90%, 95%, or 99% sequence identity to SEQ ID NO: 250). In some embodiments, the antigen binding domain that targets TRBC1 comprises a VL comprising the amino acid sequence of SEQ ID NO: 255 (or an amino acid sequence having at least about 93%, 95%, or 99% sequence identity to SEQ ID NO: 255). In some embodiments, antigen binding domain that targets TRBC1 comprises a VH comprising the amino acid sequence of SEQ ID NO: 250. In some embodiments, the antigen binding domain that targets TRBC1 comprises a VL comprising the amino acid sequence of SEQ ID NO: 255.

In some embodiments, the antigen binding domain that targets TRBC1 comprises a VH comprising the amino acid sequence of SEQ ID NO: 250, and a VL comprising the amino acid sequence of SEQ ID NO: 255.

In some embodiments, the antigen binding domain that targets TRBC1 comprises a VH comprising the amino acid sequence of SEQ ID NO: 251 (or an amino acid sequence having at least about 77%, 80%, 85%, 90%, 95%, or 99% sequence identity to SEQ ID NO: 251). In some embodiments, antigen binding domain that targets TRBC1 comprises a VH comprising the amino acid sequence of SEQ ID NO: 251.

In some embodiments, the antigen binding domain that targets TRBC1 comprises a VH comprising the amino acid sequence of SEQ ID NO: 252 (or an amino acid sequence having at least about 77%, 80%, 85%, 90%, 95%, or 99% sequence identity to SEQ ID NO: 252). In some embodiments, antigen binding domain that targets TRBC1 comprises a VH comprising the amino acid sequence of SEQ ID NO: 252.

In some embodiments, the antigen binding domain that targets TRBC1 comprises a VH comprising the amino acid sequence of SEQ ID NO: 253 (or an amino acid sequence having at least about 77%, 80%, 85%, 90%, 95%, or 99% sequence identity to SEQ ID NO: 253). In some embodiments, antigen binding domain that targets TRBC1 comprises a VH comprising the amino acid sequence of SEQ ID NO: 253.

In some embodiments, the antigen binding domain that targets TRBC1 comprises a VH comprising the amino acid sequence of SEQ ID NO: 254 (or an amino acid sequence having at least about 77%, 80%, 85%, 90%, 95%, or 99% sequence identity to SEQ ID NO: 254). In some embodiments, antigen binding domain that targets TRBC1 comprises a VH comprising the amino acid sequence of SEQ ID NO: 254.

In some embodiments, the antigen binding domain that targets TRBC1 comprises a VL comprising the amino acid sequence of SEQ ID NO: 256 (or an amino acid sequence having at least about 93%, 95%, or 99% sequence identity to SEQ ID NO: 256). In some embodiments, the antigen binding domain that targets TRBC1 comprises a VL comprising the amino acid sequence of SEQ ID NO: 256.

In some embodiments, the antigen binding domain that targets TRBC1 comprises a VL comprising the amino acid sequence of SEQ ID NO: 257 (or an amino acid sequence having at least about 93%, 95%, or 99% sequence identity to SEQ ID NO: 257). In some embodiments, the antigen binding domain that targets TRBC1 comprises a VL comprising the amino acid sequence of SEQ ID NO: 257.

In some embodiments, the antigen binding domain that targets TRBC1 comprises a VL comprising the amino acid sequence of SEQ ID NO: 258 (or an amino acid sequence having at least about 93%, 95%, or 99% sequence identity to SEQ ID NO: 258). In some embodiments, the antigen binding domain that targets TRBC1 comprises a VL comprising the amino acid sequence of SEQ ID NO: 258.

In some embodiments, the antigen binding domain that targets TRBC1 comprises a VL comprising the amino acid sequence of SEQ ID NO: 259 (or an amino acid sequence having at least about 93%, 95%, or 99% sequence identity to SEQ ID NO: 259). In some embodiments, the antigen binding domain that targets TRBC1 comprises a VL comprising the amino acid sequence of SEQ ID NO: 259.

In some embodiments, the antigen binding domain that targets TRBC1 comprises a VL comprising the amino acid sequence of SEQ ID NO: 260 (or an amino acid sequence having at least about 93%, 95%, or 99% sequence identity to SEQ ID NO: 260). In some embodiments, the antigen binding domain that targets TRBC1 comprises a VL comprising the amino acid sequence of SEQ ID NO: 260.

In some embodiments, the antigen binding domain that targets TRBC1 comprises a heavy chain comprising the amino acid sequence of SEQ ID NO: 6154 (or an amino acid sequence having at least about 93%, 95%, or 99% sequence identity to SEQ ID NO: 6154). In some embodiments, the antigen binding domain that targets TRBC1 comprises a heavy chain comprising the amino acid sequence of SEQ ID NO: 6154.

In some embodiments, the antigen binding domain that targets TRBC1 comprises a heavy chain comprising the amino acid sequence of SEQ ID NO: 6155 (or an amino acid sequence having at least about 93%, 95%, or 99% sequence identity to SEQ ID NO: 6155). In some embodiments, the antigen binding domain that targets TRBC1 comprises a heavy chain comprising the amino acid sequence of SEQ ID NO: 6155.

In some embodiments, the antigen binding domain that targets TRBC1 comprises a light chain comprising the amino acid sequence of SEQ ID NO: 6156 (or an amino acid sequence having at least about 93%, 95%, or 99% sequence identity to SEQ ID NO: 6156). In some embodiments, the antigen binding domain that targets TRBC1 comprises a light chain comprising the amino acid sequence of SEQ ID NO: 6156.

In some embodiments, the antigen binding domain that targets TRBC1 comprises a heavy chain comprising the amino acid sequence of SEQ ID NO: 6167 (or an amino acid sequence having at least about 93%, 95%, or 99% sequence identity to SEQ ID NO: 6167). In some embodiments, the antigen binding domain that targets TRBC1 comprises a heavy chain comprising the amino acid sequence of SEQ ID NO: 6167.

In some embodiments, the antigen binding domain that targets TRBC1 comprises a heavy chain comprising the amino acid sequence of SEQ ID NO: 6168 (or an amino acid sequence having at least about 93%, 95%, or 99% sequence identity to SEQ ID NO: 6168). In some embodiments, the antigen binding domain that targets TRBC1 comprises a heavy chain comprising the amino acid sequence of SEQ ID NO: 6168.

In some embodiments, the antigen binding domain that targets TRBC1 comprises a light chain comprising the amino acid sequence of SEQ ID NO: 6169 (or an amino acid sequence having at least about 93%, 95%, or 99% sequence identity to SEQ ID NO: 6169). In some embodiments, the antigen binding domain that targets TRBC1 comprises a light chain comprising the amino acid sequence of SEQ ID NO: 6169.

In some embodiments, the antigen binding domain that targets TRBC1 comprises a heavy chain comprising the amino acid sequence of SEQ ID NO: 6154 (or an amino acid sequence having at least about 93%, 95%, or 99% sequence identity to SEQ ID NO: 6154) and a light chain comprising the amino acid sequence of SEQ ID NO: 6156 (or an amino acid sequence having at least about 93%, 95%, or 99% sequence identity to SEQ ID NO: 6156). In some embodiments, the antigen binding domain that targets TRBC1 comprises a heavy chain comprising the amino acid sequence of SEQ ID NO: 6154 and a light chain comprising the amino acid sequence of SEQ ID NO: 6156.

In some embodiments, the antigen binding domain that targets TRBC1 comprises a heavy chain comprising the amino acid sequence of SEQ ID NO: 6155 (or an amino acid sequence having at least about 93%, 95%, or 99% sequence identity to SEQ ID NO: 6155) and a light chain comprising the amino acid sequence of SEQ ID NO: 6156 (or an amino acid sequence having at least about 93%, 95%, or 99% sequence identity to SEQ ID NO: 6156). In some embodiments, the antigen binding domain that targets TRBC1 comprises a heavy chain comprising the amino acid sequence of SEQ ID NO: 6155 and a light chain comprising the amino acid sequence of SEQ ID NO: 6156.

In some embodiments, the antigen binding domain that targets TRBC1 comprises a heavy chain comprising the amino acid sequence of SEQ ID NO: 6167 (or an amino acid sequence having at least about 93%, 95%, or 99% sequence identity to SEQ ID NO: 6167) and a light chain comprising the amino acid sequence of SEQ ID NO: 6169 (or an amino acid sequence having at least about 93%, 95%, or 99% sequence identity to SEQ ID NO: 6169). In some embodiments, the antigen binding domain that targets TRBC1 comprises a heavy chain comprising the amino acid sequence of SEQ ID NO: 6167 and a light chain comprising the amino acid sequence of SEQ ID NO: 6169.

In some embodiments, the antigen binding domain that targets TRBC1 comprises a heavy chain comprising the amino acid sequence of SEQ ID NO: 6168 (or an amino acid sequence having at least about 93%, 95%, or 99% sequence identity to SEQ ID NO: 6168) and a light chain comprising the amino acid sequence of SEQ ID NO: 6169 (or an amino acid sequence having at least about 93%, 95%, or 99% sequence identity to SEQ ID NO: 6169). In some embodiments, the antigen binding domain that targets TRBC1 comprises a heavy chain comprising the amino acid sequence of SEQ ID NO: 6168 and a light chain comprising the amino acid sequence of SEQ ID NO: 6169.

TABLE 2

Exemplary heavy chain CDRs and FWRs of TRBC1-targeting antigen binding domains derived from JOVI.1

| Ab ID | VHFWR1 | VHCDR1 | VHFWR2 | VHCDR2 | VHFWR3 | VHCDR3 | VHFWR4 |
|---|---|---|---|---|---|---|---|
| mJOVI.1-H | EVRLQQSG PDLIKPGAS VKMSCKAS GYT (SEQ ID NO: 203) | FTGYV MH (SEQ ID NO: 200) | WVKQRP GQGLEW IG (SEQ ID NO: 204) | FINPYND DIQSNER FRG (SEQ ID NO: 201) | KATLTSDKS STTAYMELS SLTSEDSAV YYCAR (SEQ ID NO: 205) | GAGYNF DGAYRFF DF (SEQ ID NO: 202) | WGQGT TLTVSS (SEQ ID NO: 206) |
| h1JOVI.1-H | QVQLVQSG AEVKKPGA SVKVSCKA SGYT (SEQ ID NO: 207) | FTGYV MH (SEQ ID NO: 200) | WVRQAP GQGLEW MG (SEQ ID NO: 208) | FINPYND DIQSNER FRG (SEQ ID NO: 201) | RVTMTSDK STTTAYMEL SSLRSEDTA VYYCAR (SEQ ID NO: 209) | GAGYNF DGAYRFF DF (SEQ ID NO: 202) | WGQGT LVTVSS (SEQ ID NO: 210) |
| h2JOVI.1-H | QVQLVQSG AEVKKPGA SVKVSCKA SGYT (SEQ ID NO: 211) | FTGYV MH (SEQ ID NO: 200) | WVRQAP GQGLEW MG (SEQ ID NO: 212) | FINPYND DIQSNER FRG (SEQ ID NO: 201) | WVTMTSDK SITTAYMEL SRLRSDDTA VYYCAR (SEQ ID NO: 213) | GAGYNF DGAYRFF DF (SEQ ID NO: 202) | WGQGT LVTVSS (SEQ ID NO: 214) |
| h3JOVI.1-H | QVQLVQSG AEVKKPGS SVKVSCKA SGYT (SEQ ID NO: 215) | FTGYV MH (SEQ ID NO: 200) | WVRQAP GQGLEW MG (SEQ ID NO: 216) | FINPYND DIQSNER FRG (SEQ ID NO: 201) | RVTITSDKS TTTAYMELS SLRSEDTAV YYCAR (SEQ ID NO: 217) | GAGYNF DGAYRFF DF (SEQ ID NO: 202) | WGQGT LVTVSS (SEQ ID NO: 218) |
| h4JOVI.1-H | QVQLVQSG AEVKKPGA SVKVSCKA SGYT (SEQ ID NO: 219) | FTGYV MH (SEQ ID NO: 200) | WVRQAP GQRLEW MG (SEQ ID NO: 220) | FINPYND DIQSNER FRG (SEQ ID NO: 201) | RVTITSDKS ATTAYMEL SSLRSEDTA VYYCAR (SEQ ID NO: 221) | GAGYNF DGAYRFF DF (SEQ ID NO: 202) | WGQGT LVTVSS (SEQ ID NO: 222) |

TABLE 6

Exemplary heavy chain CDRs and FWRs of
TRBC1-targeting antigen binding domains derived from
JOVI.1 (according to the Kabat Numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| mJOVI.1-H | EVRLQQSG PDLIKPGAS VKMSCKAS GYTFT (SEQ ID NO: 7370) | GYVM H (SEQ ID NO: 7346) | WVKQR PGQGLE WIG (SEQ ID NO: 204) | FINPYND DIQSNER FRG (SEQ ID NO: 201) | KATLTSDKS STTAYMELS SLTSEDSAV YYCAR (SEQ ID NO: 205) | GAGYNF DGAYRFF DF (SEQ ID NO: 202) | WGQG TTLTV SS (SEQ ID NO: 206) |
| h1JOVI.1-H | QVQLVQSG AEVKKPGA SVKVSCKA SGYTFT (SEQ ID NO: 7348) | GYVM H (SEQ ID NO: 7346) | WVRQA PGQGLE WMG (SEQ ID NO: 208) | FINPYND DIQSNER FRG (SEQ ID NO: 201) | RVTMTSDK STTTAYMEL SSLRSEDTA VYYCAR (SEQ ID NO: 209) | GAGYNF DGAYRFF DF (SEQ ID NO: 202) | WGQG TLVTV SS (SEQ ID NO: 210) |
| h2JOVI.1-H | QVQLVQSG AEVKKPGA SVKVSCKA SGYTFT (SEQ ID NO: 7348) | GYVM H (SEQ ID NO: 7346) | WVRQA PGQGLE WMG (SEQ ID NO: 212) | FINPYND DIQSNER FRG (SEQ ID NO: 201) | WVTMTSDK SITTAYMEL SRLRSDDTA VYYCAR (SEQ ID NO: 213) | GAGYNF DGAYRFF DF (SEQ ID NO: 202) | WGQG TLVTV SS (SEQ ID NO: 214) |
| h3JOVI.1-H | QVQLVQSG AEVKKPGS SVKVSCKA SGYTFT (SEQ ID NO: 7345) | GYVM H (SEQ ID NO: 7346) | WVRQA PGQGLE WMG (SEQ ID NO: 216) | FINPYND DIQSNER FRG (SEQ ID NO: 201) | RVTITSDKS TTTAYMELS SLRSEDTAV YYCAR (SEQ ID NO: 217) | GAGYNF DGAYRFF DF (SEQ ID NO: 202) | WGQG TLVTV SS (SEQ ID NO: 218) |
| h4JOVI.1-H | QVQLVQSG AEVKKPGA SVKVSCKA SGYTFT (SEQ ID NO: 7348) | GYVM H (SEQ ID NO: 7346) | WVRQA PGQRLE WMG (SEQ ID NO: 220) | FINPYND DIQSNER FRG (SEQ ID NO: 201) | RVTITSDKS ATTAYMEL SSLRSEDTA VYYCAR (SEQ ID NO: 221) | GAGYNF DGAYRFF DF (SEQ ID NO: 202) | WGQG TLVTV SS (SEQ ID NO: 222) |
| h5JOVI.1-H | QVQLVQSG AEVKKPGA SVKVSCKA SGYTFT (SEQ ID NO: 7345) | GYVM H (SEQ ID NO: 7346) | WVRQA PGQGLE WMG (SEQ ID NO: 208) | FINPYND DIQSNER FRG (SEQ ID NO: 201) | RVTITSDKS TTTAYMELS SLRSEDTAV YYCAR (SEQ ID NO: 217) | GAGYNF DGAYRFF DF (SEQ ID NO: 202) | WGQG TTVTV SS (SEQ ID NO: 7347) |
| h6JOVI.1-H | QVQLVQSG AEVKKPGA SVKVSCKA SGYTFT (SEQ ID NO: 7348) | GYVM H (SEQ ID NO: 7346) | WVRQA PGQGLE WMG (SEQ ID NO: 208) | FINPYND DIQSNER FRG (SEQ ID NO: 201) | RVTMTSDK SITTAYMEL SRLRSDDTA VYYCAR (SEQ ID NO: 7349) | GAGYNF DGAYRFF DF (SEQ ID NO: 202) | WGQG TTVTV SS (SEQ ID NO: 7347) |
| H1 germline d-VH | QVQLVQSG AEVKKPGS SVKVSCKA SGYTFS (SEQ ID NO: 7353) | GYAIS (SEQ ID NO: 7354) | WVRQA PGQGLE WMG (SEQ ID NO: 208) | FINPYND DIQSNER FRG (SEQ ID NO: 201) | RVTITSDKS TTTAYMELS SLRSEDTAV YYCAR (SEQ ID NO: 217) | GAGYNF DGAYRFF DF (SEQ ID NO: 202) | WGQG TLVTV SS (SEQ ID NO: 210) |
| H2 germline d-VH | QVQLVQSG AEVKKPGS SVKVSCKA SGYTFT (SEQ ID NO: 7345) | GYVM H (SEQ ID NO: 7346) | WVRQA PGQGLE WMG (SEQ ID NO: 208) | FIIPIFGT ANYAQK PQG (SEQ ID NO: 7355) | RVTITSDKS TTTAYMELS SLRSEDTAV YYCAR (SEQ ID NO: 217) | GAGYNF DGAYRFF DF (SEQ ID NO: 202) | WGQG TLVTV SS (SEQ ID NO: 210) |
| H1/H2 germline d-VH | QVQLVQSG AEVKKPGS SVKVSCKA SGYTFS (SEQ ID NO: 7353) | GYAIS (SEQ ID NO: 7354) | WVRQA PGQGLE WMG (SEQ ID NO: 208) | FIIPIFGT ANYAQK PQG (SEQ ID NO: 7355) | RVTITSDKS TTTAYMELS SLRSEDTAV YYCAR (SEQ ID NO: 217) | GAGYNF DGAYRFF DF (SEQ ID NO: 202) | WGQG TLVTV SS (SEQ ID NO: 210) |

TABLE 3

Exemplary light chain CDRs and FWRs of TRBC1-
targeting antigen binding domains derived from JOVI.1

| Ab ID | FWR1 | CDR1 | FWR2 | CDR2 | FWR3 | CDR3 | FWR4 |
|---|---|---|---|---|---|---|---|
| mJOVI.1-L | DVVMTQ SPLSLPV SLGDQA SISC (SEQ ID NO: 226) | RSSQRLV HSNGNT YLH (SEQ ID NO: 223) | WYLQK PGQSPK LLIY (SEQ ID NO: 227) | RVSNRF P (SEQ ID NO: 224) | GVPDRFSGS GSGTDFTLK ISRVEAEDL GIYFC (SEQ ID NO: 228) | SQSTHVP YT (SEQ ID NO: 225) | FGGGT KLEIK (SEQ ID NO: 229) |
| h1JOVI.1-L | DVVMTQ SPLSLPV TPGEPAS ISC (SEQ ID NO: 230) | RSSQRLV HSNGNT YLH (SEQ ID NO: 223) | WYLQK PGQSPQ LLIY (SEQ ID NO: 231) | RVSNRF P (SEQ ID NO: 224) | GVPDRFSGS GSGTDFTLK ISRVEAEDV GVYFC (SEQ ID NO: 232) | SQSTHVP YT (SEQ ID NO: 225) | FGGGT KVEIK (SEQ ID NO: 233) |
| h2JOVI.1-L | EVVMTQ SPGTLSL SPGERAT LSC (SEQ ID NO: 234) | RSSQRLV HSNGNT YLH (SEQ ID NO: 223) | WYQQK PGQAPR LLIY (SEQ ID NO: 235) | RVSNRF P (SEQ ID NO: 224) | GIPDRFSGS GSGTDFTLT ISRLEPEDFA VYFC (SEQ ID NO: 236) | SQSTHVP YT (SEQ ID NO: 225) | FGGGT KVEIK (SEQ ID NO: 237) |
| h3JOVI.1-L | DVVMTQ SPLSLPV TLGQPAS ISC (SEQ ID NO: 238) | RSSQRLV HSNGNT YLH (SEQ ID NO: 223) | WYQQR PGQSPR LLIY (SEQ ID NO: 239) | RVSNRF P (SEQ ID NO: 224) | GVPDRFSGS GSGTDFTLK ISRVEAEDV GVYFC (SEQ ID NO: 240) | SQSTHVP YT (SEQ ID NO: 225) | FGGGT KVEIK (SEQ ID NO: 241) |
| h4JOVI.1-L | DVVMTQ TPLSLPV TPGEPAS ISC (SEQ ID NO: 242) | RSSQRLV HSNGNT YLH (SEQ ID NO: 223) | WYLQK PGQSPQ LLIY (SEQ ID NO: 243) | RVSNRF P (SEQ ID NO: 224) | GVPDRFSGS GSGTDFTLK ISRVEAEDV GVYFC (SEQ ID NO: 244) | SQSTHVP YT (SEQ ID NO: 225) | FGGGT KVEIK (SEQ ID NO: 245) |
| h5JOVI.1-L | DVVMTQ TPLSLSV TPGQPAS ISC (SEQ ID NO: 246) | RSSQRLV HSNGNT YLH (SEQ ID NO: 223) | WYLQK PGQSPQ LLIY (SEQ ID NO: 247) | RVSNRF P (SEQ ID NO: 224) | GVPDRFSGS GSGTDFTLK ISRVEAEDV GVYFC (SEQ ID NO: 248) | SQSTHVP YT (SEQ ID NO: 225) | FGGGT KVEIK (SEQ ID NO: 249) |
| L1 germline d-VL | DVVMTQ SPLSLPV TLGQPAS ISC (SEQ ID NO: 238) | RSSQSLV YSDGNT YH (SEQ ID NO: 7367) | WYQQR PGQSPR LLIY (SEQ ID NO: 239) | RVSNRF P (SEQ ID NO: 224) | GVPDRFSGS GSGTDFTLK ISRVEAEDV GVYFC (SEQ ID NO: 232) | SQSTHVP YT (SEQ ID NO: 225) | FGGGT KVEIK (SEQ ID NO: 233) |
| L2 germline d-VL | DVVMTQ SPLSLPV TLGQPAS ISC (SEQ ID NO: 238) | RSSQRLV HSNGNT YLH (SEQ ID NO: 223) | WYQQR PGQSPR LLIY (SEQ ID NO: 239) | KVSNR DS (SEQ ID NO: 7368) | GVPDRFSGS GSGTDFTLK ISRVEAEDV GVYFC (SEQ ID NO: 232) | SQSTHVP YT (SEQ ID NO: 225) | FGGGT KVEIK (SEQ ID NO: 233) |
| L3 germline d-VL | DVVMTQ SPLSLPV TLGQPAS ISC (SEQ ID NO: 238) | RSSQRLV HSNGNT YLH (SEQ ID NO: 223) | WYQQR PGQSPR LLIY (SEQ ID NO: 239) | RVSNRF P (SEQ ID NO: 224) | GVPDRFSGS GSGTDFTLK ISRVEAEDV GVYFC (SEQ ID NO: 232) | MQSTHW PYT (SEQ ID NO: 7369) | FGGGT KVEIK (SEQ ID NO: 233) |
| L1/L2/L3 germline d-VL | DVVMTQ SPLSLPV TLGQPAS ISC (SEQ ID NO: 238) | RSSQSLV YSDGNT YH (SEQ ID NO: 7367) | WYQQR PGQSPR LLIY (SEQ ID NO: 239) | KVSNR DS (SEQ ID NO: 7368) | GVPDRFSGS GSGTDFTLK ISRVEAEDV GVYFC (SEQ ID NO: 232) | MQSTHW PYT (SEQ ID NO: 7369) | FGGGT KVEIK (SEQ ID NO: 233) |

TABLE 4

Exemplary variable regions of TRBC1-targeting antigen binding domains

| SEQ ID NO | Ab ID | Description | Sequence |
|---|---|---|---|
| SEQ ID NO: 250 | mJOVI.1-H | JOVI.1 heavy chain variable region | EVRLQQSGPDLIKPGASVKMSCKASGYTFTGYVMH WVKQRPGQGLEWIGFINPYNDDIQSNERFRGKATLT SDKSSTTAYMELSSLTSEDSAVYYCARGAGYNFDG AYRFFDFWGQGTTLTVSS |
| SEQ ID NO: 251 | h1JOVI.1-H | JOVI.1 heavy chain variable region humanized variant 1 | QVQLVQSGAEVKKPGASVKVSCKASGYTFTGYVM HWVRQAPGQGLEWMGFINPYNDDIQSNERFRGRVT MTSDKSTTTAYMELSSLRSEDTAVYYCARGAGYNF DGAYRFFDFWGQGTLVTVSS |
| SEQ ID NO: 252 | h2JOVI.1-H | JOVI.1 heavy chain variable region humanized variant 2 | QVQLVQSGAEVKKPGASVKVSCKASGYTFTGYVM HWVRQAPGQGLEWMGFINPYNDDIQSNERFRGWV TMTSDKSITTAYMELSRLRSDDTAVYYCARGAGYN FDGAYRFFDFWGQGTLVTVSS |
| SEQ ID NO: 253 | h3JOVI.1-H | JOVI.1 heavy chain variable region humanized variant 3 | QVQLVQSGAEVKKPGSSVKVSCKASGYTFTGYVM HWVRQAPGQGLEWMGFINPYNDDIQSNERFRGRVT ITSDKSTTTAYMELSSLRSEDTAVYYCARGAGYNFD GAYRFFDFWGQGTLVTVSS |
| SEQ ID NO: 254 | h4JOVI.1-H | JOVI.1 heavy chain variable region humanized variant 4 | QVQLVQSGAEVKKPGASVKVSCKASGYTFTGYVM HWVRQAPGQRLEWMGFINPYNDDIQSNERFRGRVT ITSDKSATTAYMELSSLRSEDTAVYYCARGAGYNF DGAYRFFDFWGQGTLVTVSS |
| SEQ ID NO: 7343 | h5JOVI.1-H | JOVI.1 heavy chain variable region humanized variant 5 | QVQLVQSGAEVKKPGSSVKVSCKASGYTFTGYVM HWVRQAPGQGLEWMGFINPYNDDIQSNERFRGRVT ITSDKSTTTAYMELSSLRSEDTAVYYCARGAGYNFD GAYRFFDFWGQGTTVTVSS |
| SEQ ID NO: 7344 | h6JOVI.1-H | JOVI.1 heavy chain variable region humanized variant 6 | QVQLVQSGAEVKKPGASVKVSCKASGYTFTGYVM HWVRQAPGQGLEWMGFINPYNDDIQSNERFRGRVT MTSDKSITTAYMELSRLRSDDTAVYYCARGAGYNF DGAYRFFDFWGQGTTVTVSS |
| SEQ ID NO: 7350 | H1 germlined-VH | JOVI.1 heavy chain variable region humanized H1 | QVQLVQSGAEVKKPGSSVKVSCKASGYTFSGYAIS WVRQAPGQGLEWMGFINPYNDDIQSNERFRGRVTI TSDKSTTTAYMELSRSEDTAVYYCARGAGYNFD GAYRFFDFWGQGTLVTVSS |
| SEQ ID NO: 7351 | H2 germlined-VH | JOVI.1 heavy chain variable region humanized H2 | QVQLVQSGAEVKKPGSSVKVSCKASGYTFTGYVM HWVRQAPGQGLEWMGFIIPIFGTANYAQKFQGRVT ITSDKSTTTAYMELSSLRSEDTAVYYCARGAGYNFD GAYRFFDFWGQGTLVTVSS |
| SEQ ID NO: 7352 | H1/H2 germlined-VH | JOVI.1 heavy chain variable region humanized H1/H2 | QVQLVQSGAEVKKPGSSVKVSCKASGYTFSGYAIS WVRQAPGQGLEWMGFIIPIFGTANYAQKFQGRVTIT SDKSTTTAYMELSSLRSEDTAVYYCARGAGYNFDG AYRFFDFWGQGTLVTVSS |
| SEQ ID NO: 255 | mJOVI.1-L | JOVI.1 light chain variable region | DVVMTQSPLSLPVSLGDQASISCRSSQRLVHSNGNT YLHWYLQKPGQSPKLLIYRVSNRFPGVPDRFSGSGS GTDFTLKISRVEAEDLGIYFCSQSTHVPYTFGGGTKL EIK |
| SEQ ID NO: 256 | mJOVI.1-L | JOVI.1 light chain variable region humanized variant 1 | DVVMTQSPLSLPVTPGEPASISCRSSQRLVHSNGNT YLHWYLQKPGQSPQLLIYRVSNRFPGVPDRFSGSGS GTDFTLKISRVEAEDVGVYFCSQSTHVPYTFGGGTK VEIK |
| SEQ ID NO: 257 | h2JOVI.1-L | JOVI.1 light chain variable region humanized variant 2 | EVVMTQSPGTLSLSPGERATLSCRSSQRLVHSNGNT YLHWYQQKPGQAPRLLIYRVSNRFPGIPDRFSGSGS GTDFTLTISRLEPEDFAVYFCSQSTHVPYTFGGGTKV EIK |
| SEQ ID NO: 258 | h3JOVI.1-L | JOVI.1 light chain variable region humanized variant 3 | DVVMTQSPLSLPVTLGQPASISCRSSQRLVHSNGNT YLHWYQQRPGQSPRLLIYRVSNRFPGVPDRFSGSGS GTDFTLKISRVEAEDVGVYFCSQSTHVPYTFGGGTK VEIK |
| SEQ ID NO: 259 | h4JOVI.1-L | JOVI.1 light chain variable region humanized variant 4 | DVVMTQTPLSLPVTPGEPASISCRSSQRLVHSNGNT YLHWYLQKPGQSPQLLIYRVSNRFPGVPDRFSGSGS GTDFTLKISRVEAEDVGVYFCSQSTHVPYTFGGGTK VEIK |

TABLE 4-continued

Exemplary variable regions of TRBC1-targeting antigen binding domains

| SEQ ID NO | Ab ID | Description | Sequence |
|---|---|---|---|
| SEQ ID NO: 260 | h5JOVI.1-L | JOVI.1 light chain variable region humanized variant 5 | DVVMTQTPLSLSVTPGQPASISCRSSQRLVHSNGNT YLHWYLQKPGQSPQLLIYRVSNRFPGVPDRFSGSGS GTDFTLKISRVEAEDVGVYFCSQSTHVPYTFGGGTK VEIK |
| SEQ ID NO: 7357 | L1 germlined-VL | JOVI.1 light chain variable region humanized L1 | DVVMTQSPLSLPVTLGQPASISCRSSQSLVYSDGNT YHWYQQRPGQSPRLLIYRVSNRFPGVPDRFSGSGSG TDFTLKISRVEAEDVGVYFCSQSTHVPYTFGGGTKV EIK |
| SEQ ID NO: 7358 | L2 germlined-VL | JOVI.1 light chain variable region humanized L2 | DVVMTQSPLSLPVTLGQPASISCRSSQRLVHSNGNT YLHWYQQRPGQSPRLLIYKVSNRDSGVPDRFSGSGS GTDFTLKISRVEAEDVGVYFCSQSTHVPYTFGGGTK VEIK |
| SEQ ID NO: 7359 | L3 germlined-VL | JOVI.1 light chain variable region humanized L3 | DVVMTQSPLSLPVTLGQPASISCRSSQRLVHSNGNT YLHWYQQRPGQSPRLLIYRVSNRFPGVPDRFSGSGS GTDFTLKISRVEAEDVGVYFCMQSTHWPYTFGGGT KVEIK |
| SEQ ID NO: 7360 | L1/L2/L3 germlined-VL | JOVI.1 light chain variable region humanized L1/L2/L3 | DVVMTQSPLSLPVTLGQPASISCRSSQSLVYSDGNT YHWYQQRPGQSPRLLIYKVSNRDSGVPDRFSGSGS GTDFTLKISRVEAEDVGVYFCMQSTHWPYTFGGGT KVEIK |

TABLE 5

Exemplary TRBC1-targeting antigen binding domains/antibody molecules

| SEQ ID NO | Ab ID | Description | Sequence |
|---|---|---|---|
| SEQ ID NO: 6154 | Ch(anti-TRBC1)HC N297A | Anti-TRBC1 heavy chain | EVRLQQSGPDLIKPGASVKMSCKASGYTFTGYVMHWVK QRPGQGLEWIGFINPYNDDIQSNERFRGKATLTSDKSSTTA YMELSSLTSEDSAVYYCARGAGYNFDGAYRFFDFWGQGT TLTVSSASTKGPSVFPLAPSSKSTSGGTAALGCLVKDYFPE PVTVSWNSGALTSGVHTFPAVLQSSGLYSLSSVVTVPSSSL GTQTYICNVNHKPSNTKVDKRVEPKSCDKTHTCPPCPAPE LLGGPSVFLFPPKPKDTLMISRTPEVTCVVVDVSHEDPEVK FNWYVDGVEVHNAKTKPREEQYASTYRVVSVLTVLHQD WLNGKEYKCKVSNKALPAPIEKTISKAKGQPREPQVYTLP PCREEMTKNQVSLWCLVKGFYPSDIAVEWESNGQPENNY KTTPPVLDSDGSFFLYSKLTVDKSRWQQGNVFSCSVMHE ALHNHYTQKSLSLSPGK |
| SEQ ID NO: 6155 | Ch(anti-TRBC1)HC | Anti-TRBC1 heavy chain | EVRLQQSGPDLIKPGASVKMSCKASGYTFTGYVMHWVK QRPGQGLEWIGFINPYNDDIQSNERFRGKATLTSDKSSTTA YMELSSLTSEDSAVYYCARGAGYNFDGAYRFFDFWGQGT TLTVSSASTKGPSVFPLAPSSKSTSGGTAALGCLVKDYFPE PVTVSWNSGALTSGVHTFPAVLQSSGLYSLSSVVTVPSSSL GTQTYICNVNHKPSNTKVDKRVEPKSCDKTHTCPPCPAPE LLGGPSVFLFPPKPKDTLMISRTPEVTCVVVDVSHEDPEVK FNWYVDGVEVHNAKTKPREEQYNSTYRVVSVLTVLHQD WLNGKEYKCKVSNKALPAPIEKTISKAKGQPREPQVYTLP PCREEMTKNQVSLWCLVKGFYPSDIAVEWESNGQPENNY KTTPPVLDSDGSFFLYSKLTVDKSRWQQGNVFSCSVMHE ALHNHYTQKSLSLSPGK |
| SEQ ID NO: 6156 | Ch(anti-TRBC1) LC | Anti-TRBC1 light chain, e.g., a LC Fab | DVVMTQSPLSLPVSLGDQASISCRSSQRLVHSNGNTYLHW YLQKPGQSPKLLIYRVSNRFPGVPDRFSGSGSGTDFTLKIS RVEAEDLGIYFCSQSTHVPYTFGGGTKLEIKRTVAAPSVFI FPPSDEQLKSGTASVVCLLNNFYPREAKVQWKVDNALQS GNSQESVTEQDSKDSTYSLSSTLTLSKADYEKHKVYACEV THQGLSSPVTKSFNRGEC |
| SEQ ID NO: 6191 | Ch(anti-TRBC1)HC | Anti-TRBC1 heavy chain, e.g., a HC Fab | EVRLQQSGPDLIKPGASVKMSCKASGYTFTGYVMHWVK QRPGQGLEWIGFINPYNDDIQSNERFRGKATLTSDKSSTTA YMELSSLTSEDSAVYYCARGAGYNFDGAYRFFDFWGQGT TLTVSSASTKGPSVFPLAPSSKSTSGGTAALGCLVKDYFPE PVTVSWNSGALTSGVHTFPAVLQSSGLYSLSSVVTVPSSSL GTQTYICNVNHKPSNTKVDKRVEPKSC |

TABLE 5-continued

Exemplary TRBC1-targeting antigen binding domains/antibody molecules

| SEQ ID NO | Ab ID | Description | Sequence |
|---|---|---|---|
| SEQ ID NO: 6167 | a_hTRBC1_Jovi1_Hum5_VH-hCHIg_Hole_Cys-Blank | Anti-TRBC1 heavy chain | METDTLLLWVLLLWVPGSTGQVQLVQSGAEVKKPGSSV KVSCKASGYTFTGYVMHWVRQAPGQGLEWMGFINPYND DIQSNERFRGRVTITSDKSTTTAYMELSSLRSEDTAVYYCA RGAGYNFDGAYRFFDFWGQGTLVTVSSASTKGPSVFPLA PSSKSTSGGTAALGCLVKDYFPEPVTVSWNSGALTSGVHT FPAVLQSSGLYSLSSVVTVPSSSLGTQTYICNVNHKPSNTK VDKRVEPKSCDKTHTCPPCPAPELLGGPSVFLFPPKPKDTL MISRTPEVTCVVVDVSHEDPEVKFNWYVDGVEVHNAKT KPREEQYNSTYRVVSVLTVLHQDWLNGKEYKCKVSNKA LPAPIEKTISKAKGQPREPQVCTLPPSREEMTKNQVSLSCA VKGFYPSDIAVEWESNGQPENNYKTTPPVLDSDGSFFLVS KLTVDKSRWQQGNVFSCSVMHEALHNHYTQKSLSLSPGK |
| SEQ ID NO: 6168 | a_hTRBC1_Jovi1_Hum5_VH-hCHIg-Blank | Anti-TRBC1 heavy chain | METDTLLLWVLLLWVPGSTGQVQLVQSGAEVKKPGSSV KVSCKASGYTFTGYVMHWVRQAPGQGLEWMGFINPYND DIQSNERFRGRVTITSDKSTTTAYMELSSLRSEDTAVYYCA RGAGYNFDGAYRFFDFWGQGTLVTVSSASTKGPSVFPLA PSSKSTSGGTAALGCLVKDYFPEPVTVSWNSGALTSGVHT FPAVLQSSGLYSLSSVVTVPSSSLGTQTYICNVNHKPSNTK VDKRVEPKSCDKTHTCPPCPAPELLGGPSVFLFPPKPKDTL MISRTPEVTCVVVDVSHEDPEVKFNWYVDGVEVHNAKT KPREEQYNSTYRVVSVLTVLHQDWLNGKEYKCKVSNKA LPAPIEKTISKAKGQPREPQVYTLPPSREEMTKNQVSLTCL VKGFYPSDIAVEWESNGQPENNYKTTPPVLDSDGSFFLYS KLTVDKSRWQQGNVFSCSVMHEALHNHYTQKSLSLSPGK |
| SEQ ID NO: 6169 | a_hTRBC1_Jovi1_Hum3_VL-hCLIg_vk-Blank | Anti-TRBC1 light chain | METDTLLLWVLLLWVPGSTGDVVMTQSPLSLPVTLGQPA SISCRSSQRLVHSNGNTYLHWYQQRPGQSPRLLIYRVSNR FPGVPDRFSGSGSGTDFTLKISRVEAEDVGVYFCSQSTHVP YTFGGGTKVEIKRTVAAPSVFIFPPSDEQLKSGTASVVCLL NNFYPREAKVQWKVDNALQSGNSQESVTEQDSKDSTYSL SSTLTLSKADYEKHKVYACEVTHQGLSSPVTKSFNRGEC |

Antibody Molecules that Bind to TRBC1/TRBC2 and NKp30

Figure 29B:
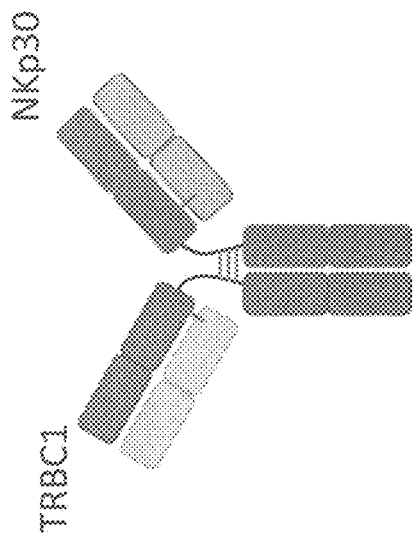
FIGS. 29A-29D are schematic representations of anti-TRBC1/NKp30 antibodies.
Figure 29D:
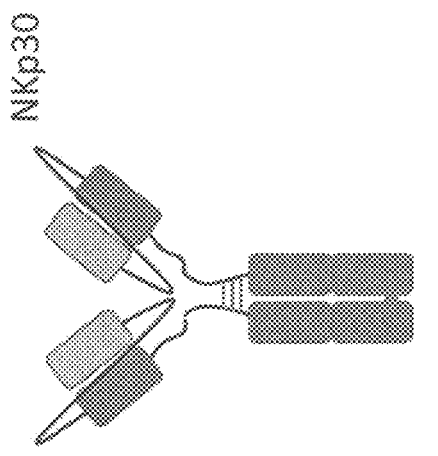
Figure 29A:
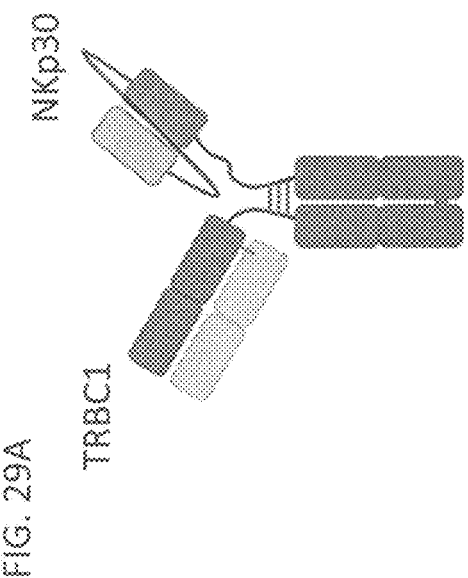
Figure 29C:
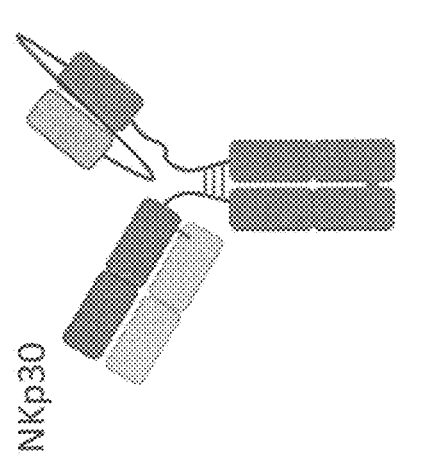

In some embodiments, the disclosure features a multifunctional antibody molecule that binds to TRBC1 and NKp30. In some embodiments, the multifunctional antibody molecule comprises a configuration shown in any of FIGS. 29A-29D. In some embodiments, the multifunctional antibody molecule comprises an anti-TRBC1 Fab. In some embodiments, the multifunctional antibody molecule comprises an anti-TRBC1 scFv. In some embodiments, the multifunctional antibody molecule comprises an anti-NKp30 Fab. In some embodiments, the multifunctional antibody molecule comprises an anti-NKp30 scFv. In some embodiments, the multifunctional antibody molecule comprises an anti-TRBC1 Fab and an anti-NKp30 scFv, e.g., comprises a configuration shown in FIG. 29A. In some embodiments, the multifunctional antibody molecule comprises an anti-TRBC1 Fab and an anti-NKp30 Fab, e.g., comprises a configuration shown in FIG. 29B. In some embodiments, the multifunctional antibody molecule comprises an anti-NKp30 Fab and an anti-TRBC1 scFv, e.g., comprises a configuration shown in FIG. 29C. In some embodiments, the multifunctional antibody molecule comprises an anti-TRBC1 scFv and an anti-NKp30 scFv, e.g., comprises a configuration shown in FIG. 29D. In some embodiments, the multifunctional antibody molecule comprises an anti-TRBC1 antigen binding domain disclosed herein. In some embodiments, the multifunctional antibody molecule comprises an anti-NKp30 antigen binding domain disclosed herein.

In some embodiments, exemplary multifunctional antibody molecules that bind to TRBC1 and NKp30 are disclosed in Table 19.

In some embodiments, the multifunctional antibody molecule comprises an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto). In some embodiments, the anti-TRBC1/NKp30 antibody molecule comprises an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7311 (or a sequence having at least 85%, 90%, 95%, or 99% identity thereto). In some embodiments, the anti-TRBC1/NKp30 antibody molecule comprises SEQ ID NOs: 7382, 7380, and 7383 (or a sequence having at least 85%, 90%, 95%, or 99% identity thereto).

In some embodiments, the multifunctional antibody molecule comprises an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7309 (or a sequence having at least 85%, 90%, 95%, or 99% identity thereto). In some embodiments, the anti-TRBC1/NKp30 antibody molecule comprises an anti-TRBC1 VH of SEQ ID NO: 253 (or a sequence having at least 85%, 90%, 95%, or 99% identity thereto), an anti-TRBC1 VL of SEQ ID NO:

258 (or a sequence having at least 85%, 90%, 95%, or 99% identity thereto), and an anti-NKp30 scFv of SEQ ID NO: 7311 (or a sequence having at least 85%, 90%, 95%, or 99% identity thereto). In some embodiments, the anti-TRBC1/NKp30 antibody molecule comprises SEQ ID NOs: 7379, 7380, and 7383 (or a sequence having at least 85%, 90%, 95%, or 99% identity thereto).

In some embodiments, the multifunctional antibody molecule comprises an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7305 (or a sequence having at least 85%, 90%, 95%, or 99% identity thereto). In some embodiments, the anti-TRBC1/NKp30 antibody molecule comprises an anti-TRBC1 VH of SEQ ID NO: 7351 (or a sequence having at least 85%, 90%, 95%, or 99% identity thereto), an anti-TRBC1 VL of SEQ ID NO: 258 (or a sequence having at least 85%, 90%, 95%, or 99% identity thereto), and an anti-NKp30 scFv of SEQ ID NO: 7310 (or a sequence having at least 85%, 90%, 95%, or 99% identity thereto). In some embodiments, the anti-TRBC1/NKp30 antibody molecule comprises SEQ ID NOs: 7382, 7380, and 7384 (or a sequence having at least 85%, 90%, 95%, or 99% identity thereto).

In some embodiments, the multifunctional antibody molecule comprises an anti-TRBC1 VH of SEQ ID NO: 253 (or a sequence having at least 85%, 90%, 95%, or 99% identity thereto), an anti-TRBC1 VL of SEQ ID NO: 258 (or a sequence having at least 85%, 90%, 95%, or 99% identity thereto), an anti-NKp30 VH of SEQ ID NO: 7302 (or a sequence having at least 85%, 90%, 95%, or 99% identity thereto), and an anti-NKp30 VL of SEQ ID NO: 7305 (or a sequence having at least 85%, 90%, 95%, or 99% identity thereto). In some embodiments, the anti-TRBC1/NKp30 antibody molecule comprises an anti-TRBC1 VH of SEQ ID NO: 253 (or a sequence having at least 85%, 90%, 95% or 99% identity thereto), an anti-TRBC1 VL of SEQ ID NO: 258 (or a sequence having at least 85%, 90%, 95% or 99% identity thereto), and an anti-NKp30 scFv of SEQ ID NO: 7310 (or a sequence having at least 85%, 90%, 95% or 99% identity thereto). In some embodiments, the anti-TRBC1/NKp30 antibody molecule comprises SEQ ID NOs: 7379, 7380, and 7384 (or a sequence having at least 85%, 90%, 95% or 99% identity thereto).

TABLE 19

Exemplary antibody molecules that bind to TRBC1 and NKp30

| SEQ ID NO | Description | Sequence |
|---|---|---|
| BJM0772 | | |
| SEQ ID NO: 7379 | anti-TRBC1 HC | QVQLVQSGAEVKKPGSSVKVSCKASGYTFTGYVMEIWVRQAPGQG LEWMGFINPYNDDIQSNERFRGRVTITSDKSTTTAYMELSSLRSEDT AVYYCARGAGYNFDGAYRFFDFWGQGTLVTVSSASTKGPSVFPLA PSSKSTSGGTAALGCLVKDYFPEPVTVSWNSGALTSGVHTFPAVLQ SSGLYSLSSVVTVPSSSLGTQTYICNVNEIKPSNTKVDKRVEPKSCD KTHTCPPCPAPELLGGPSVFLFPPKPKDTLMISRTPEVTCVVVDVSH EDPEVKFNWYVDGVEVHNAKTKPREEQYASTYRVVSVLTVLHQD WLNGKEYKCKVSNKALPAPIEKTISKAKGQPREPQVYTLPPCREEM TKNQVSLWCLVKGFYPSDIAVEWESNGQPENNYKTTPPVLDSDGS FFLYSKLTVDKSRWQQGNVFSCSVMHEALHNHYTQKSLSLSPGK |
| SEQ ID NO: 7380 | anti-TRBC1 LC | DVVMTQSPLSLPVTLGQPASISCRSSQRLVHSNGNTYLHWYQQRPG QSPRLLIYRVSNRFPGVPDRFSGSGSGTDFTLKISRVEAEDVGVYFCS QSTHVPYTFGGGTKVEIKRTVAAPSVFIFPPSDEQLKSGTASVVCLL NNFYPREAKVQWKVDNALQSGNSQESVTEQDSKDSTYSLSSTLTLS KADYEKHKVYACEVTHQGLSSPVTKSFNRGEC |
| SEQ ID NO: 7381 | anti-NKp30 15E1 scFv-Fc | QIQLQESGPGLVKPSQSLSLSCSVTGFSITTTGYHWNWIRQFPGKKL EWMGYIYSSGSTSYNPSLKSRFSITRDTSKNQFFLQLNSVTTEDTAT YYCARGDWHYFDYWGPGTMVTVSSGGGGSGGGGSGGGGSGGGG SSFTLTQPPLVSVAVGQVATITCSGEKLSDKYVHWYQQKPGRAPVM VIYENDRRPSGIPDQFSGSNSGNIASLTISKAQAGDEADYFCQFWDS TNSAVFGGGTQLTVLDKTHTCPPCPAPELLGGPSVFLFPPKPKDTLM ISRTPEVTCVVVDVSHEDPEVKFNWYVDGVEVHNAKTKPREEQYA STYRVVSVLTVLHQDWLNGKEYKCKVSNKALPAPIEKTISKAKGQP REPQVCTLPPSREEMTKNQVSLSCAVKGFYPSDIAVEWESNGQPEN NYKTTPPVLDSDGSFFLVSKLTVDKSRWQQGNVFSCSVMHEALHN RFTQKSLSLSPGK |
| BJM1042 | | |
| SEQ ID NO: 7382 | anti-TRBC1 HC | QVQLVQSGAEVKKPGSSVKVSCKASGYTFTGYVMHWVRQAPGQG LEWMGFIIPIFGTANYAQKFQGRVTITSDKSTTTAYMELSSLRSEDT AVYYCARGAGYNFDGAYRFFDFWGQGTLVTVSSASTKGPSVFPLA PSSKSTSGGTAALGCLVKDYFPEPVTVSWNSGALTSGVHTFPAVLQ SSGLYSLSSVVTVPSSSLGTQTYICNVNHKPSNTKVDKRVEPKSCDK THTCPPCPAPELLGGPSVFLFPPKPKDTLMISRTPEVTCVVVDVSHED PEVKFNWYVDGVEVHNAKTKPREEQYASTYRVVSVLTVLHQDWL NGKEYKCKVSNKALPAPIEKTISKAKGQPREPQVYTLPPCREEMTK NQVSLWCLVKGFYPSDIAVEWESNGQPENNYKTTPPVLDSDGSFFL YSKLTVDKSRWQQGNVFSCSVMHEALHNHYTQKSLSLSPGK |

TABLE 19-continued

Exemplary antibody molecules that bind to TRBC1 and NKp30

| SEQ ID NO | Description | Sequence |
|---|---|---|
| SEQ ID NO: 7380 | anti-TRBC1 LC | DVVMTQSPLSLPVTLGQPASISCRSSQRLVHSNGNTYLHWYQQRPG QSPRLLIYRVSNRFPGVPDRFSGSGSGTDFTLKISRVEAEDVGVYFCS QSTHVPYTFGGGTKVEIKRTVAAPSVFIFPPSDEQLKSGTASVVCLL NNFYPREAKVQWKVDNALQSGNSQESVTEQDSKDSTYSLSSTLTLS KADYEKHKVYACEVTHQGLSSPVTKSFNRGEC |
| SEQ ID NO: 7383 | anti-NKp30 humanized 15E1 scFv-Fc | EIQLLESGGGLVQPGGSLRLSCAVSGFSITTTGYHWNWVRQAPGKG LEWVGYIYSSGSTSYNPSLKSRFTISRDTSKNTFYLQMNSLRAEDTA VYYCARGDWHYFDYWGQGTMVTVSSGGGGSGGGGSGGGGSGGG GSDSVTTQSPLSLPVTLGQPASISCSGEKLSDKYVHWYQQRPGQSPR MLIYENDRRPSGVPDRFSGSNSGNDATLKISRVEAEDVGVYFCQFW DSTNSAVFGGGTKVEIKDKTHTCPPCPAPELLGGPSVFLFPPKPKDT LMISRTPEVTCVVVDVSHEDPEVKFNWYVDGVEVHNAKTKPREEQ YASTYRVVSVLTVLHQDWLNGKEYKCKVSNKALPAPIEKTISKAKG QPREPQVCTLPPSREEMTKNQVSLSCAVKGFYPSDIAVEWESNGQP ENNYKTTPPVLDSDGSFFLVSKLTVDKSRWQQGNVFSCSVMHEAL HNHYTQKSLSLSPGK |

BJM1052

| SEQ ID NO | Description | Sequence |
|---|---|---|
| SEQ ID NO: 7379 | anti-TRBC1 HC | QVQLVQSGAEVKKPGSSVKVSCKASGYTFTGYVMHWVRQAPGQG LEWMGFINPYNDDIQSNERFRGRVTITSDKSTTTAYMELSSLRSEDT AVYYCARGAGYNFDGAYRFFDFWGQGTLVTVSSASTKGPSVFPLA PSSKSTSGGTAALGCLVKDYFPEPVTVSWNSGALTSGVHTFPAVLQ SSGLYSLSSVVTVPSSSLGTQTYICNVNHKPSNTKVDKRVEPKSCDK THTCPPCPAPELLGGPSVFLFPPKPKDTLMISRTPEVTCVVVDVSHED PEVKFNWYVDGVEVHNAKTKPREEQYASTYRVVSVLTVLHQDWL NGKEYKCKVSNKALPAPIEKTISKAKGQPREPQVYTLPPCREEMTK NQVSLWCLVKGFYPSDIAVEWESNGQPENNYKTTPPVLDSDGSFFL YSKLTVDKSRWQQGNVFSCSVMHEALHNHYTQKSLSLSPGK |
| SEQ ID NO: 7380 | anti-TRBC1 LC | DVVMTQSPLSLPVTLGQPASISCRSSQRLVHSNGNTYLHWYQQRPG QSPRLLIYRVSNRFPGVPDRFSGSGSGTDFTLKISRVEAEDVGVYFCS QSTHVPYTFGGGTKVEIKRTVAAPSVFIFPPSDEQLKSGTASVVCLL NNFYPREAKVQWKVDNALQSGNSQESVTEQDSKDSTYSLSSTLTLS KADYEKHKVYACEVTHQGLSSPVTKSFNRGEC |
| SEQ ID NO: 7383 | anti-NKp30 humanized 15E1 scFv-Fc | EIQLLESGGGLVQPGGSLRLSCAVSGFSITTTGYHWNWVRQAPGKG LEWVGYIYSSGSTSYNPSLKSRFTISRDTSKNTFYLQMNSLRAEDTA VYYCARGDWHYFDYWGQGTMVTVSSGGGGSGGGGSGGGGSGGG GSDSVTTQSPLSLPVTLGQPASISCSGEKLSDKYVHWYQQRPGQSPR MLIYENDRRPSGVPDRFSGSNSGNDATLKISRVEAEDVGVYFCQFW DSTNSAVFGGGTKVEIKDKTHTCPPCPAPELLGGPSVFLFPPKPKDT LMISRTPEVTCVVVDVSHEDPEVKFNWYVDGVEVHNAKTKPREEQ YASTYRVVSVLTVLHQDWLNGKEYKCKVSNKALPAPIEKTISKAKG QPREPQVCTLPPSREEMTKNQVSLSCAVKGFYPSDIAVEWESNGQP ENNYKTTPPVLDSDGSFFLVSKLTVDKSRWQQGNVFSCSVMHEAL HNHYTQKSLSLSPGK |

BJM1038

| SEQ ID NO | Description | Sequence |
|---|---|---|
| SEQ ID NO: 7382 | anti-TRBC1 HC | QVQLVQSGAEVKKPGSSVKVSCKASGYTFTGYVMHWVRQAPGQG LEWMGFIIPIFGTANYAQKFQGRVTITSDKSTTTAYMELSSLRSEDT AVYYCARGAGYNFDGAYRFFDFWGQGTLVTVSSASTKGPSVFPLA PSSKSTSGGTAALGCLVKDYFPEPVTVSWNSGALTSGVHTFPAVLQ SSGLYSLSSVVTVPSSSLGTQTYICNVNHKPSNTKVDKRVEPKSCDK THTCPPCPAPELLGGPSVFLFPPKPKDTLMISRTPEVTCVVVDVSHED PEVKFNWYVDGVEVHNAKTKPREEQYASTYRVVSVLTVLHQDWL NGKEYKCKVSNKALPAPIEKTISKAKGQPREPQVYTLPPCREEMTK NQVSLWCLVKGFYPSDIAVEWESNGQPENNYKTTPPVLDSDGSFFL YSKLTVDKSRWQQGNVFSCSVMHEALHNHYTQKSLSLSPGK |
| SEQ ID NO: 7380 | anti-TRBC1 LC | DVVMTQSPLSLPVTLGQPASISCRSSQRLVHSNGNTYLHWYQQRPG QSPRLLIYRVSNRFPGVPDRFSGSGSGTDFTLKISRVEAEDVGVYFCS QSTHVPYTFGGGTKVEIKRTVAAPSVFIFPPSDEQLKSGTASVVCLL NNFYPREAKVQWKVDNALQSGNSQESVTEQDSKDSTYSLSSTLTLS KADYEKHKVYACEVTHQGLSSPVTKSFNRGEC |
| SEQ ID NO: 7384 | anti-NKp30 humanized 15E1 scFv-Fc | EIQLLESGGGLVQPGGSLRLSCAVSGFSITTTGYHWNWVRQAPGKG LEWVGYIYSSGSTSYNPSLKSRFTISRDTSKNTFYLQMNSLRAEDTA VYYCARGDWHYFDYWGQGTMVTVSSGGGGSGGGGSGGGGSGGG GSSSETTQPPSVSVSPGQTASITCSGEKLSDKYVHWYQQKPGQSPV MVIYENDRRPSGIPERFSGSNSGNTATLTISGTQAMDEADYFCQFWD STNSAVFGGGTQLTVLDKTHTCPPCPAPELLGGPSVFLFPPKPKDTL MISRTPEVTCVVVDVSHEDPEVKFNWYVDGVEVHNAKTKPREEQY |

TABLE 19-continued

Exemplary antibody molecules that bind to TRBC1 and NKp30

| SEQ ID NO | Description | Sequence |
|---|---|---|
| | | ASTYRVVSVLTVLHQDWLNGKEYKCKVSNKALPAPIEKTISKAKGQ PREPQVCTLPPSREEMTKNQVSLSCAVKGFYPSDIAVEWESNGQPE NNYKTTPPVLDSDGSFFLVSKLTVDKSRWQQGNVFSCSVMHEALH NHYTQKSLSLSPGK |
| BJM1048 | | |
| SEQ ID NO: 7379 | anti-TRBC1 HC | QVQLVQSGAEVKKPGSSVKVSCKASGYTFTGYVMHWVRQAPGQG LEWMGFINPYNDDIQSNERFRGRVTITSDKSTTTAYMELSSLRSEDT AVYYCARGAGYNFDGAYRFFDFWGQGTLVTVSSASTKGPSVFPLA PSSKSTSGGTAALGCLVKDYFPEPVTVSWNSGALTSGVHTFPAVLQ SSGLYSLSSVVTVPSSSLGTQTYICNVNHKPSNTKVDKRVEPKSCDK THTCPPCPAPELLGGPSVFLFPPKPKDTLMISRTPEVTCVVVDVSHED PEVKFNWYVDGVEVHNAKTKPREEQYASTYRVVSVLTVLHQDWL NGKEYKCKVSNKALPAPIEKTISKAKGQPREPQVYTLPPCREEMTK NQVSLWCLVKGFYPSDIAVEWESNGQPENNYKTTPPVLDSDGSFFL YSKLTVDKSRWQQGNVFSCSVMHEALHNHYTQKSLSLSPGK |
| SEQ ID NO: 7380 | anti-TRBC1 LC | DVVMTQSPLSLPVTLGQPASISCRSSQRLVHSNGNTYLHWYQQRPG QSPRLLIYRVSNRFPGVPDRFSGSGSGTDFTLKISRVEAEDVGVYFCS QSTHVPYTFGGGTKVEIKRTVAAPSVFIFPPSDEQLKSGTASVVCLL NNFYPREAKVQWKVDNALQSGNSQESVTEQDSKDSTYSLSSTLTLS KADYEKHKVYACEVTHQGLSSPVTKSFNRGEC |
| SEQ ID NO: 7384 | anti-NKp30 humanized 15E1 scFv-Fc | EIQLLESGGGLVQPGGSLRLSCAVSGFSITTTGYHWNWVRQAPGKG LEWVGYIYSSGSTSYNPSLKSRFTISRDTSKNTFYLQMNSLRAEDTA VYYCARGDWHYFDYWGQGTMVTVSSGGGGSGGGGSGGGGSGGG GSSSETTQPPSVSVSPGQTASITCSGEKLSDKYVHWYQQKPGQSPV MVIYENDRRPSGIPERFSGSNSGNTATLTISGTQAMDEADYFCQFWD STNSAVFGGGTQLTVLDKTHTCPPCPAPELLGGPSVFLFPPKPKDTL MISRTPEVTCVVVDVSHEDPEVKFNWYVDGVEVHNAKTKPREEQY ASTYRVVSVLTVLHQDWLNGKEYKCKVSNKALPAPIEKTISKAKGQ PREPQVCTLPPSREEMTKNQVSLSCAVKGFYPSDIAVEWESNGQPE NNYKTTPPVLDSDGSFFLVSKLTVDKSRWQQGNVFSCSVMHEALH NHYTQKSLSLSPGK |

Figure 30A:
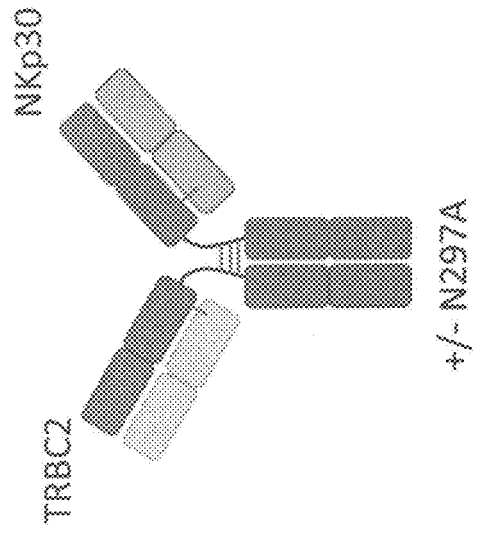
FIGS. 30A-30D are schematic representations of anti-TRBC1/NKp30 antibodies.
Figure 30B:
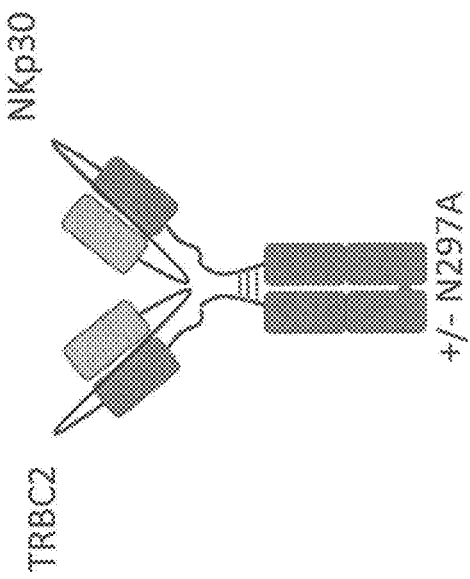
Figure 30C:
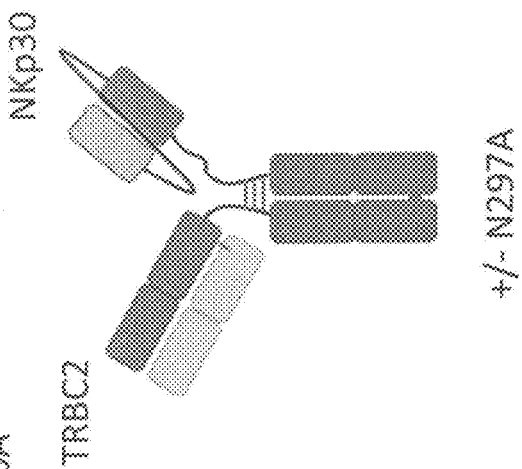
Figure 30D:
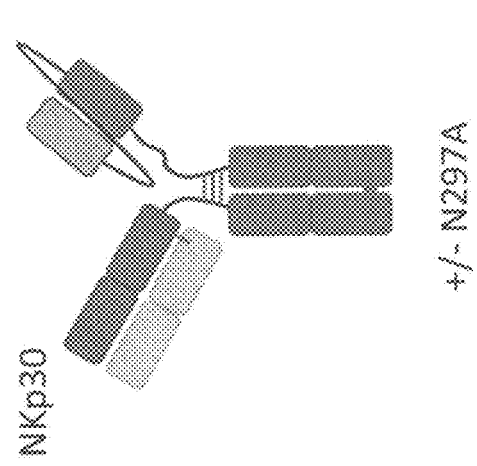

In some embodiments, the disclosure features a multifunctional antibody molecule that binds to TRBC2 and NKp30. In some embodiments, the multifunctional antibody molecule comprises a configuration shown in any of FIGS. 30A-30D. In some embodiments, the multifunctional antibody molecule comprises an anti-TRBC2 Fab. In some embodiments, the multifunctional antibody molecule comprises an anti-TRBC2 scFv. In some embodiments, the multifunctional antibody molecule comprises an anti-NKp30 Fab. In some embodiments, the multifunctional antibody molecule comprises an anti-NKp30 scFv. In some embodiments, the multifunctional antibody molecule comprises an anti-TRBC2 Fab and an anti-NKp30 scFv, e.g., comprises a configuration shown in FIG. 30A. In some embodiments, the multifunctional antibody molecule comprises an anti-TRBC2 Fab and an anti-NKp30 Fab, e.g., comprises a configuration shown in FIG. 30B. In some embodiments, the multifunctional antibody molecule comprises an anti-NKp30 Fab and an anti-TRBC2 scFv, e.g., comprises a configuration shown in FIG. 30C. In some embodiments, the multifunctional antibody molecule comprises an anti-TRBC2 scFv and an anti-NKp30 scFv, e.g., comprises a configuration shown in FIG. 30D. In some embodiments, the multifunctional antibody molecule comprises an anti-TRBC2 antigen binding domain disclosed herein. In some embodiments, the multifunctional antibody molecule comprises an anti-NKp30 antigen binding domain disclosed herein.

Multifunctional Antibody Effector Function and Fc Variants

In some embodiments, the multifunctional molecule (e.g., an anti-TRBC1/NKp30 antibody molecule or an anti-TRBC2/NKp30 antibody molecule) disclosed herein comprises an Fc region, e.g., as described herein. In some embodiments, the Fc region is a wildtype Fc region, e.g., a wildtype human Fc region. In some embodiments, the Fc region comprises a variant, e.g., an Fc region comprising an addition, substitution, or deletion of at least one amino acid residue in the Fc region which results in, e.g., reduced or ablated affinity for at least one Fc receptor.

The Fc region of an antibody interacts with a number of receptors or ligands including Fc Receptors (e.g., FcγRI, FcγRIIA, FcγRIIIA), the complement protein C1q, and other molecules such as proteins A and G. These interactions are essential for a variety of effector functions and downstream signaling events including: antibody dependent cell-mediated cytotoxicity (ADCC), Antibody-dependent cellular phagocytosis (ADCP) and complement dependent cytotoxicity (CDC).

In some embodiments, the multifunctional molecule (e.g., an anti-TRBC1/NKp30 antibody molecule or an anti-TRBC2/NKp30 antibody molecule) comprising a variant Fc region has reduced, e.g., ablated, affinity for an Fc receptor, e.g., an Fc receptor described herein. In some embodiments, the reduced affinity is compared to an otherwise similar antibody with a wild type Fc region.

In some embodiments, the multifunctional molecule (e.g., an anti-TRBC1/NKp30 antibody molecule or an anti-TRBC2/NKp30 antibody molecule) comprising a variant Fc region has one or more of the following properties: (1) reduced effector function (e.g., reduced ADCC, ADCP and/or CDC); (2) reduced binding to one or more Fc receptors; and/or (3) reduced binding to C1q complement. In some embodiments, the reduction in any one, or all of properties (1)-(3) is compared to an otherwise similar antibody with a wildtype Fc region.

In some embodiments, the multifunctional molecule (e.g., an anti-TRBC1/NKp30 antibody molecule or an anti-TRBC2/NKp30 antibody molecule) comprising a variant Fc region has reduced affinity to a human Fc receptor, e.g., FcγR I, FcγR II and/or FcγR III. In some embodiments, the multifunctional molecule (e.g., an anti-TRBC1/NKp30 antibody molecule or an anti-TRBC2/NKp30 antibody molecule) comprising a variant Fc region comprises a human IgG1 region or a human IgG4 region.

Exemplary Fc region variants are provided in Table 20 and also disclosed in Saunders O, (2019) *Frontiers in Immunology*; vol 10, article 1296, the entire contents of which is hereby incorporated by reference.

In some embodiments, the multifunctional molecule (e.g., an anti-TRBC1/NKp30 antibody molecule or an anti-TRBC2/NKp30 antibody molecule) comprises any one or all, or any combination of Fc region variants, e.g., mutations, disclosed in Table 20. In some embodiments, the multifunctional molecule (e.g., an anti-TRBC1/NKp30 antibody molecule or an anti-TRBC2/NKp30 antibody molecule) comprises an Asn297Ala (N297A) mutation. In some embodiments, the multifunctional molecule (e.g., an anti-TRBC1/NKp30 antibody molecule or an anti-TRBC2/NKp30 antibody molecule) comprises a Leu234Ala/Leu235Ala (LALA) mutation.

TABLE 20

Exemplary Fc modifications

| Modification or mutation | Altered effector function |
|---|---|
| Leu235Glu | ADCC; |
| Leu234Ala/Leu235Ala (LALA) | ADCC; ADCP; CDC |
| Ser228Pro/Leu235Glu | |
| Leu234Ala/Leu235Ala/Pro329Gly | ADCP |
| Pro331Ser/Leu234Glu/Leu235Phe | CDC |
| Asp265Ala | ADCC, ADCP |
| Gly237Ala | ADCP |
| Glu318Ala | ADCP |
| Glu233Pro | |
| Gly236Arg/Leu328Arg | ADCC |
| His268GlnNa1309Leu/Ala330Ser/Pro331Ser | ADCC; ADCP; CDC |
| Val234Ala/Gly237Ala/Pro238Ser/ His268AlaNa1309Leu/Ala330Ser/Pro331Ser | ADCC; ADCP; CDC |
| Leu234Ala/L235Ala/Gly237Ala/P238Ser/ His268Ala/Ala330Ser/Pro331Ser | ADCC; CDC |
| Ala330Leu | CDC |
| Asp270Ala | CDC |
| Lys322Ala | CDC |
| Pro329Ala | CDC |
| Pro331Ala | CDC |
| Val264Ala | CDC |
| High mannose glycosylation | CDC |
| Phe241Ala | CDC |
| Asn297Ala or Gly or Gln | ADCC; ADCP; CDC |
| S228P/Phe234Ala/Leu235Ala | ADCC; CDC |

Antibody Molecules Targeting TRBC1

In another aspect, the present disclosure features an antibody molecule, e.g., a monoclonal antibody molecule, or fragment thereof that binds TRBC1.

In some embodiments, the antibody molecule, or fragment thereof, that binds to TRBC1 comprises one or more CDRs (e.g., VHCDR1, VHCDR2, VHCDR3, VLCDR1, VLCDR2, and/or VLCDR3) disclosed in Table 2, Table 6, Table 3, or a sequence having at least 85%, 90%, 95%, or 99% identity thereto. In some embodiments, the antibody molecule, or fragment thereof, that binds to TRBC1 comprises one or more framework regions (e.g., VHFWR1, VHFWR2, VHFWR3, VHFWR4, VLFWR1, VLFWR2, VLFWR3, and/or VLFWR4) disclosed in Table 2, Table 6, or Table 3, or a sequence having at least 85%, 90%, 95%, or 99% identity thereto. In some embodiments, the antibody molecule, or fragment thereof, that binds to TRBC1 comprises a VH and/or a VL disclosed in Table 4, or a sequence having at least 85%, 90%, 95%, or 99% identity thereto. In some embodiments, the antibody molecule, or fragment thereof, that binds to TRBC1 comprises an amino acid sequence disclosed in Table 5, or a sequence having at least 85%, 90%, 95%, or 99% identity thereto.

In some embodiments, the antibody molecule, or fragment thereof, that binds to TRBC1 comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3.

In some embodiments, the VHCDR1, VHCDR2, and VHCDR3 comprise the amino acid sequences of SEQ ID NOs: 7346, 7355, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7346, 201, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7354, 201, and 202, respectively (or a sequence having at least 85%, 90%, 95%, or 99% identity thereto). In some embodiments, the VHCDR1, VHCDR2, and VHCDR3 comprise the amino acid sequences of SEQ ID NOs: 7354, 7355, and 202, respectively (or a sequence having at least 85%, 90%, 95%, or 99% identity thereto).

In some embodiments, the VLCDR1, VLCDR2, and VLCDR3 comprise the amino acid sequences of SEQ ID NOs: 223, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 7367, 224, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 223, 7368, and 225, respectively (or a sequence having at least 85%, 90%, 95%, or 99% identity thereto). In some embodiments, the VLCDR1, VLCDR2, and VLCDR3 comprise the amino acid sequences of SEQ ID NOs: 223, 224, and 7369, respectively (or a sequence having at least 85%, 90%, 95%, or 99% identity thereto). In some embodiments, the VLCDR1, VLCDR2, and VLCDR3 comprise the amino acid sequences of SEQ ID NOs: 7367, 7368, and 7369, respectively (or a sequence having at least 85%, 90%, 95%, or 99% identity thereto).

In some embodiments, the VHCDR1, VHCDR2, VHCDR3, VLCDR1, VLCDR2, and VLCDR3 comprise the amino acid sequences of SEQ ID NOs: 7346, 7355, 202, 223, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7346, 201, 202, 223, 224, and 225, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of: SEQ ID NOs: 7346, 7355, 202, 7367, 224, and 225, respectively (or a sequence having at least 85%, 90%, 95%, or 99% identity thereto); SEQ ID NOs: 7346, 7355, 202, 223, 7368, and 225, respectively (or a sequence having at least 85%, 90%, 95%, or 99% identity thereto); SEQ ID NOs: 7346, 7355, 202, 223, 224, and 7369, respectively (or a sequence having at least 85%, 90%, 95%, or 99% identity thereto); SEQ ID NOs: 7346, 7355, 202, 7367, 7368, and 7369, respectively (or a sequence having at least 85%, 90%, 95%, or 99% identity thereto); SEQ ID NOs: 7346, 201, 202, 7367, 224, and 225, respectively (or a sequence having at least 85%, 90%, 95%, or 99% identity thereto); SEQ ID NOs: 7346, 201, 202, 223, 7368, and 225, respectively (or a sequence having at least 85%, 90%, 95%, or 99% identity thereto); SEQ ID NOs: 7346, 201, 202, 223, 224, and 7369, respectively (or a sequence having at least 85%, 90%, 95%, or 99% identity thereto); SEQ ID NOs: 7346, 201, 202, 7367, 7368, and 7369, respectively (or a sequence having at least 85%, 90%, 95%, or 99% identity thereto); SEQ ID NOs: 7354, 201, 202, 223, 224, and 225, respectively (or a sequence having at least 85%, 90%, 95%, or 99% identity thereto); SEQ ID NOs: 7354, 201, 202, 7367, 224, and 225, respectively (or a sequence having at least 85%, 90%, 95%, or 99% identity thereto); SEQ ID NOs: 7354, 201, 202, 223, 7368, and 225, respectively (or a sequence having at least 85%, 90%, 95%, or 99% identity thereto); SEQ ID NOs: 7354, 201, 202, 223, 224, and 7369, respectively (or a sequence having at least 85%, 90%, 95%, or 99% identity thereto); SEQ ID NOs: 7354, 201, 202, 7367, 7368, and 7369, respectively (or a sequence having at least 85%, 90%, 95%, or 99% identity thereto); SEQ ID NOs: 7354, 7355, 202, 223, 224, and 225, respectively (or a sequence having at least 85%, 90%, 95%, or 99% identity thereto); SEQ ID NOs: 7354, 7355, 202, 7367, 224, and 225, respectively (or a sequence having at least 85%, 90%, 95%, or 99% identity thereto); SEQ ID NOs: 7354, 7355, 202, 223, 7368, and 225, respectively (or a sequence having at least 85%, 90%, 95%, or 99% identity thereto); SEQ ID NOs: 7354, 7355, 202, 223, 224, and 7369, respectively (or a sequence having at least 85%, 90%, 95%, or 99% identity thereto); or SEQ ID NOs: 7354, 7355, 202, 7367, 7368, and 7369, respectively (or a sequence having at least 85%, 90%, 95%, or 99% identity thereto).

In some embodiments, the VH comprises an amino acid sequence selected from the group consisting of SEQ ID NOs: 7351, 253, 250-252, 254, 7343, 7344, 7350, and 7352 (or a sequence having at least 85%, 90%, 95%, or 99% identity thereto) and/or the VL comprises an amino acid sequence selected from the group consisting of SEQ ID NOs: 258, 255-257, 259, 260, and 7357-7360 (or a sequence having at least 85%, 90%, 95%, or 99% identity thereto). In some embodiments, the VH and VL comprise the amino acid sequences of SEQ ID NOs: 7351 and 258, respectively (or a sequence having at least 85%, 90%, 95%, or 99% identity thereto). In some embodiments, the VH and VL comprise the amino acid sequences of SEQ ID NOs: 253 and 258, respectively (or a sequence having at least 85%, 90%, 95%, or 99% identity thereto).

In some embodiments, the antibody molecule or fragment thereof comprises:
  a heavy chain variable region (VH) comprising a heavy chain framework region 1 (VHFWR1) amino acid sequence of SEQ ID NO: 215 (or a sequence with no more than 1, 2, 3, 4, 5, or 6 mutations, e.g., substitutions, additions, or deletions, therefrom), a VHFWR2 amino acid sequence of SEQ ID NO: 216 (or a sequence with no more than 1, 2, 3, 4, 5, or 6 mutations, e.g., substitutions, additions, or deletions, therefrom), a VHFWR3 amino acid sequence of SEQ ID NO: 217 (or a sequence with no more than 1, 2, 3, 4, 5, or 6 mutations, e.g., substitutions, additions, or deletions, therefrom), and/or a VHFWR4 amino acid sequence of SEQ ID NO: 218 (or a sequence with no more than 1, 2, 3, 4, 5, or 6 mutations, e.g., substitutions, additions, or deletions, therefrom), and
  a light chain variable region (VL) comprising a light chain framework region 1 (VLFWR1) amino acid sequence of SEQ ID NO: 238 (or a sequence with no more than 1, 2, 3, 4, 5, or 6 mutations, e.g., substitutions, additions, or deletions, therefrom), a VLFWR2 amino acid sequence of SEQ ID NO: 239 (or a sequence with no more than 1, 2, 3, 4, 5, or 6 mutations, e.g., substitutions, additions, or deletions, therefrom), a VLFWR3 amino acid sequence of SEQ ID NO: 240 (or a sequence with no more than 1, 2, 3, 4, 5, or 6 mutations, e.g., substitutions, additions, or deletions, therefrom), and/or a VLFWR4 amino acid sequence of SEQ ID NO: 241 (or a sequence with no more than 1, 2, 3, 4, 5, or 6 mutations, e.g., substitutions, additions, or deletions, therefrom).

In some embodiments, the antibody molecule or fragment thereof comprises a VH comprising a VHCDR1 amino acid sequence of SEQ ID NO: 200, a VHCDR2 amino acid sequence of SEQ ID NO: 201, and/or a VHCDR3 amino acid sequence of SEQ ID NO: 202.

In some embodiments, the antibody molecule or fragment thereof comprises a VL comprising a VLCDR1 amino acid sequence of SEQ ID NO: 223, a VLCDR2 amino acid sequence of SEQ ID NO: 224, and a VLCDR3 amino acid sequence of SEQ ID NO: 225.

In some embodiments, the antibody molecule or fragment thereof comprises a VH comprising the amino acid sequence of SEQ ID NO: 253 (or an amino acid sequence having at least about 75%, 80%, 85%, 90%, 95%, or 99% sequence identity thereto), and/or a VL comprising the amino acid sequence of SEQ ID NO: 258 (or an amino acid sequence having at least about 93%, 95%, or 99% sequence identity thereto). In some embodiments, the antibody molecule or fragment thereof comprises a VH and/or VL substantially homologous to SEQ ID NOs: 253 and/or 258.

In another aspect, the disclosure features an antibody molecule, e.g., an IgM antibody molecule comprising: (i) a first antigen binding domain that selectively binds to T cell receptor beta chain constant domain 1 (TRBC1) or T cell receptor beta chain constant domain 2 (TRBC2), and (ii) a complement activating domain that activates the complement pathway, e.g., by binding C1q. In some embodiments, an antibody molecule, e.g., IgM antibody molecule, comprises an antigen binding domain that targets TRBC1. In some embodiments, the antibody molecule is an IgM antibody molecule, e.g., that multimerizes into tetramers, pentamers, and/or hexamers and is capable of activating complement pathway(s). In some embodiments, the IgM antibody molecule comprises an antigen binding domain that targets TRBC1 comprising a heavy chain comprising the amino acid sequence of SEQ ID NO: 6173 (or an amino acid sequence having at least about 93%, 95%, or 99% sequence identity to SEQ ID NO: 6173).

(SEQ ID NO: 6173)
METDTLLLWVLLLWVPGSTGQVQLVQSGAEVKKPGSSVKVSCKASGYTFTG

YVMHWVRQAPGQGLEWMGFINPYNDDIQSNERFRGRVTITSDKSTTTAYME

-continued

```
LSSLRSEDTAVYYCARGAGYNFDGAYRFFDFWGQGTLVTVSSGSASAPTLF

PLVSCENSPSDTSSVAVGCLAQDFLPDSITFSWKYKNNSDISSTRGFPSVL

RGGKYAATSQVLLPSKDVMQGTDEHVVCKVQHPNGNKEKNVPLPVIAELPP

KVSVFVPPRDGFFGNPRKSKLICQATGFSPRQIQVSWLREGKQVGSGVTTD

QVQAEAKESGPTTYKVTSTLTIKESDWLGQSMFTCRVDHRGLTFQQNASSM

CVPDQDTAIRVFAIPPSFASIFLTKSTKLTCLVTDLTTYDSVTISWTRQNG

EAVKTHTNISESHPNATFSAVGEASICEDDWNSGERFTCTVTHTDLPSPLK

QTISRPKGVALHRPDVYLLPPAREQLNLRESATITCLVTGFSPADVFVQWM

QRGQPLSPEKYVTSAP1VIPEPQAPGRYFAHSILTVSEEEWNTGETYTCVV

AHEALPNRVTERTVDKSTGKPTLYNVSLVMSDTAGTCY.
```

In some embodiments, the IgM antibody molecule comprises an antigen binding domain that targets TRBC1 comprising a light chain comprising the amino acid sequence of SEQ ID NO: 6174 (or an amino acid sequence having at least about 93%, 95%, or 99% sequence identity to SEQ ID NO: 6174).

```
                                      (SEQ ID NO: 6174)
MKNHLLFWGVLAVFIKAVHVKAQEDERIVLVDNKCKCARITSRIIRSSEDP

NEDIVERNIRIIVPLNNRENISDPTSPLRTRFVYHLSDLCKKCDPTEVELD

NQIVTATQSNICDEDSATETCYTYDRNKCYTAVVPLVYGGETKMVETALTP

DACYPD.
```

In some embodiments, the IgM antibody molecule comprises an antigen binding domain that targets TRBC1 comprising amino acid sequences of SEQ ID NO: 6173 and 6174 (or amino acid sequences having at least about 93%, 95%, or 99% sequence identity to SEQ ID NO: 6173 and 6174) and an amino acid sequence of a light chain sequence provided herein, e.g., in Tables 3 or 4.

In some embodiments, the complement activating domain comprises a portion of an antibody molecule capable of binding or being bound by C1q, e.g., a portion of a IgG1, IgG2, IgG3, IgG4, IgM, IgA1, IgA2, IgD, or IgE. In some embodiments, a complement activating domain comprises a Ch2, Ch3, or Ch4 domain.

Without wishing to be bound by theory, it is thought that complement activation in proximity to a target cell (e.g., a TRBC1 or TRBC2 expressing cell, e.g., a lymphocyte expressing TRBC1 or TRBC2, e.g., a lymphoma cell expressing TRBC1 or TRBC2) may induce the death of the target cell. In some embodiments, use of an antibody molecule, e.g., IgM antibody molecule, or a multifunctional molecule in the methods described herein induces complement mediated cell death of the target cell.

In another aspect, the disclosure features a multispecific antibody molecule (e.g., a bispecific antibody molecule) that binds to TRBC1 and NKp30. In some embodiments, the multispecific antibody molecule comprises one or more moieties that bind to TRBC1, e.g., one or more Fabs that bind to TRBC1, e.g., one or two Fabs that bind to TRBC1. In some embodiments, the multispecific antibody molecule comprises one or more moieties that bind to NKp30, e.g., one or more scFvs that bind to NKp30, e.g., one or two scFvs that bind to NKp30. In some embodiments, the moiety that binds to TRBC1 comprises an anti-TRBC1 sequence disclosed herein, e.g., comprises a CDR, VH, VL, heavy chain, or light chain sequence disclosed in Tables 2-5, or a sequence having at least 70, 80, 90, 95, or 99% identity thereto. In some embodiments, the moiety that binds to NKp30 comprises an anti-NKp30 sequence disclosed herein, e.g., comprises a CDR, VH, VL, heavy chain, or light chain sequence disclosed in Tables 7-10, or a sequence having at least 70, 80, 90, 95, or 99% identity thereto.

In some embodiments, the multispecific antibody molecule comprises a configuration shown in FIG. 1A. In some embodiments, the multispecific antibody molecule comprises an anti-TRBC1 antibody molecule and an anti-NKp30 antibody molecule, e.g., an anti-TRBC1 antibody molecule comprising two heavy chains and two light chains, and an anti-NKp30 scFv that is fused to the N-terminus of one of the heavy chains of the anti-TRBC1 antibody. In some embodiments, the two heavy chains of the anti-TRBC1 antibody form a heterodimer, e.g., via knob-and-hole mutations. In some embodiments, the two heavy chains of the anti-TRBC1 antibody comprise the N297A mutation. In some embodiments, the two heavy chains of the anti-TRBC1 antibody do not comprise the N297A mutation. In some embodiments, the multispecific antibody molecule comprises a first chain, a second chain, a third chain, and a fourth chain, wherein the first chain comprises an anti-TRBC1 light chain variable region (VL) and a light chain constant region (CL); the second chain comprises an anti-NKp30 scFv, an anti-TRBC1 heavy chain variable region (VH), a CH1, a CH2, and a CH3; the third chain comprises an anti-TRBC1 VH, a CH1, a CH2, and a CH3; and the fourth chain comprises an anti-TRBC1 VL and a CL.

In some embodiments, the multispecific antibody molecule comprises a configuration shown in FIG. 1B. In some embodiments, the multispecific antibody molecule comprises an anti-TRBC1 antibody molecule and an anti-NKp30 antibody molecule. In some embodiments, the multispecific antibody molecule comprises an anti-TRBC1 Fab, an anti-NKp30 scFv, and an Fc dimer comprising two Fc chains. In some embodiments, the C-terminus of the heavy chain of the anti-TRBC1 Fab is fused to the N-terminus of one Fc chain, and the anti-NKp30 scFv is fused to the N-terminus of the other Fc chain. In some embodiments, the two Fc chains form a heterodimer, e.g., via knob-and-hole mutations. In some embodiments, the two Fc chains comprise the N297A mutation. In some embodiments, the two Fc chains do not comprise the N297A mutation. In some embodiments, the multispecific antibody molecule comprises a first chain, a second chain, and a third chain, wherein the first chain comprises an anti-TRBC1 VL and a CL; the second chain comprises an anti-TRBC1 VH, a CH1, a CH2, and a CH3; and the third chain comprises an anti-NKp30 scFv, a CH2, and a CH3.

In some embodiments, the multispecific antibody molecule comprises a configuration shown in FIG. 1C. In some embodiments, the multispecific antibody molecule comprises an anti-TRBC1 antibody molecule and an anti-NKp30 antibody molecule, e.g., an anti-TRBC1 antibody molecule comprising two heavy chains and two light chains, and two anti-NKp30 scFvs that are fused to the C-terminus of the two light chains of the anti-TRBC1 antibody molecule, respectively. In some embodiments, the two heavy chains of the anti-TRBC1 antibody form a homodimer. In some embodiments, the two heavy chains of the anti-TRBC1 antibody comprise the N297A mutation. In some embodiments, the two heavy chains of the anti-TRBC1 antibody do not comprise the N297A mutation. In some embodiments, the multispecific antibody molecule comprises a first chain, a second chain, a third chain, and a fourth chain, wherein the first chain comprises an anti-TRBC1 VL, a CL, and an anti-NKp30 scFv; the second chain comprises an anti-TRBC1 VH, a CH1, a CH2, and a CH3; the third chain comprises an anti-TRBC1 VH, a CH1, a CH2, and a CH3; and the fourth chain comprises an anti-TRBC1 VL, a CL, and an anti-NKp30 scFv.

In some embodiments, the multispecific antibody molecule comprises a configuration shown in FIG. 1D. In some embodiments, the multispecific antibody molecule comprises an anti-TRBC1 antibody molecule and an anti-NKp30 antibody molecule, e.g., an anti-TRBC1 antibody molecule comprising two heavy chains and two light chains, and two anti-NKp30 scFvs that are fused to the N-terminus of the two heavy chains of the anti-TRBC1 antibody molecule, respectively. In some embodiments, the two heavy chains of the anti-TRBC1 antibody form a homodimer. In some embodiments, the two heavy chains of the anti-TRBC1 antibody comprise the N297A mutation. In some embodiments, the two heavy chains of the anti-TRBC1 antibody do not comprise the N297A mutation. In some embodiments, the multispecific antibody molecule comprises a first chain, a second chain, a third chain, and a fourth chain, wherein the first chain comprises an anti-TRBC1 VL and a CL; the second chain comprises an anti-NKp30 scFv, an anti-TRBC1 VH, a CH1, a CH2, and a CH3; the third chain comprises an anti-NKp30 scFv, an anti-TRBC1 VH, a CH1, a CH2, and a CH3; and the fourth chain comprises an anti-TRBC1 VL and a CL.

In another aspect, the disclosure features an antibody molecule that comprises a moiety that binds to TRBC1 and a TRAIL molecule (e.g., a trimeric, dimeric, or monomeric TRAIL molecule). In some embodiments, the antibody molecule comprises one or more moieties that bind to TRBC1, e.g., one or more Fabs that bind to TRBC1, e.g., one Fab that binds to TRBC1. In some embodiments, the moiety that binds to TRBC1 comprises an anti-TRBC1 sequence disclosed herein, e.g., comprises a CDR, VH, VL, heavy chain, or light chain sequence disclosed in Tables 2-5, or a sequence having at least 70, 80, 90, 95, or 99% identity thereto. In some embodiments, the antibody molecule comprises a TRAIL molecule (e.g., a trimeric, dimeric, or monomeric TRAIL molecule). In some embodiments, each monomer of TRAIL comprises amino acid residues 122-281 of human TRAIL, or a sequence having at least 70, 80, 90, 95, or 99% identity thereto. In some embodiments, each monomer of TRAIL comprises amino acid residues 95-281 of human TRAIL, or a sequence having at least 70, 80, 90, 95, or 99% identity thereto.

In some embodiments, the antibody molecule comprises a configuration shown in FIGS. 2A-2F. In some embodiments, the antibody molecule comprises a moiety that binds to TRBC1 and a trimeric, dimeric, or monomeric TRAIL molecule, e.g., comprises an anti-TRBC1 Fab, a trimeric, dimeric, or monomeric TRAIL molecule, and an Fc dimer comprising two Fc chains. In some embodiments, the two Fc chains form a heterodimer, e.g., via knob-and-hold mutations. In some embodiments, the two Fc chains comprise the N297A mutation. In some embodiments, the two Fc chains do not comprise the N297A mutation. In some embodiments, the C-terminus of the heavy chain of the anti-TRBC1 Fab is fused to the N-terminus of one Fc chain. In some embodiments, the trimeric, dimeric, or monomeric TRAIL molecule is fused to the N-terminus of the other Fc chain. In some embodiments, the antibody molecule comprises a first chain, a second chain, and a third chain. In some embodiments, the first chain comprises an anti-TRBC1 VL and a CL, e.g., comprises the amino acid sequence of SEQ ID NO: 6169, or a sequence having at least 70, 80, 90, 95, or 99% identity thereto. In some embodiments, the second chain comprises an anti-TRBC1 VH, a CH1, a CH2, and a CH3, e.g., comprises the amino acid sequence of SEQ ID NO: 6167, or a sequence having at least 70, 80, 90, 95, or 99% identity thereto. In some embodiments, the third chain comprises a trimeric TRAIL molecule, a CH2, and a CH3, e.g., comprises the amino acid sequence of SEQ ID NO: 6159 or 6162, or a sequence having at least 70, 80, 90, 95, or 99% identity thereto. In some embodiments, the third chain comprises a dimeric TRAIL molecule, a CH2, and a CH3, e.g., comprises the amino acid sequence of SEQ ID NO: 6158 or 6161, or a sequence having at least 70, 80, 90, 95, or 99% identity thereto. In some embodiments, the third chain comprises a monomeric TRAIL molecule, a CH2, and a CH3, e.g., comprises the amino acid sequence of SEQ ID NO: 6157 or 6160, or a sequence having at least 70, 80, 90, 95, or 99% identity thereto.

In another aspect, the disclosure features a multispecific antibody molecule (e.g., a bispecific antibody molecule) that binds to TRBC1 and DR5. In some embodiments, the multispecific antibody molecule comprises one or more moieties that bind to TRBC1, e.g., one or more Fabs that bind to TRBC1, e.g., one Fab that binds to TRBC1. In some embodiments, the multispecific antibody molecule comprises one or more moieties that bind to DR5, e.g., one or more scFvs that bind to DR5, e.g., one or two scFvs that bind to DR5. In some embodiments, the moiety that binds to TRBC1 comprises an anti-TRBC1 sequence disclosed herein, e.g., comprises a CDR, VH, VL, heavy chain, or light chain sequence disclosed in Tables 2-5, or a sequence having at least 70, 80, 90, 95, or 99% identity thereto. In some embodiments, the moiety that binds to DR5 comprises an anti-DR5 sequence disclosed herein, e.g., comprises a CDR, VH, VL, heavy chain, or light chain sequence disclosed in Table 11, or a sequence having at least 70, 80, 90, 95, or 99% identity thereto.

In some embodiments, the multispecific antibody molecule comprises a configuration shown in FIG. 3A. In some embodiments, the multispecific antibody molecule comprises an anti-TRBC1 Fab, an anti-DR5 scFv, and an Fc dimer comprising two Fc chains. In some embodiments, the two Fc chains form a heterodimer, e.g., via knob-and-hold mutations. In some embodiments, the two Fc chains comprise the N297A mutation. In some embodiments, the two Fc chains do not comprise the N297A mutation. In some embodiments, the C-terminus of the heavy chain of the anti-TRBC1 Fab is fused to the N-terminus of one Fc chain. In some embodiments, the anti-DR5 scFv is fused to the N-terminus of the other Fc chain. In some embodiments, the multispecific antibody molecule comprises a first chain, a second chain, and a third chain. In some embodiments, the first chain comprises an anti-TRBC1 VL and a CL, e.g., comprises the amino acid sequence of SEQ ID NO: 6169, or a sequence having at least 70, 80, 90, 95, or 99% identity thereto. In some embodiments, the second chain comprises an anti-TRBC1 VH, a CH1, a CH2, and a CH3, e.g., comprises the amino acid sequence of SEQ ID NO: 6167, or a sequence having at least 70, 80, 90, 95, or 99% identity thereto. In some embodiments, the third chain comprises an anti-DR5 scFv, a CH2, and a CH3, e.g., comprises the amino acid sequence of SEQ ID NO: 6163, or a sequence having at least 70, 80, 90, 95, or 99% identity thereto.

In some embodiments, the multispecific antibody molecule comprises a configuration shown in FIG. 3B. In some embodiments, the multispecific antibody molecule comprises an anti-TRBC1 antibody molecule and an anti-DR5 antibody molecule, e.g., an anti-TRBC1 antibody molecule comprising two heavy chains and two light chains, and two anti-DR5 scFvs that are fused to the C-terminus of the two light chains of the anti-TRBC1 antibody, respectively. In some embodiments, the two heavy chains of the anti-TRBC1 antibody comprise the N297A mutation. In some embodiments, the two heavy chains of the anti-TRBC1 antibody do not comprise the N297A mutation. In some embodiments, the multispecific antibody molecule comprises a first chain, a second chain, a third chain, and a fourth chain. In some embodiments, the first chain comprises an anti-TRBC1 VL, a CL, and an anti-DR5 scFv, e.g., comprises the amino acid sequence of SEQ ID NO: 6170, or a sequence having at least 70, 80, 90, 95, or 99% identity thereto. In some embodiments, the second chain comprises an anti-TRBC1 VH, a CH1, a CH2, and a CH3, e.g., comprises the amino acid sequence of SEQ ID NO: 6168, or a sequence having at least 70, 80, 90, 95, or 99% identity thereto. In some embodiments, the fourth chain comprises an anti-TRBC1 VH, a CH1, a CH2, and a CH3, e.g., comprises the amino acid sequence of SEQ ID NO: 6168, or a sequence having at least 70, 80, 90, 95, or 99% identity thereto. In some embodiments, the first chain comprises an anti-TRBC1 VL, a CL, and an anti-DR5 scFv, e.g., comprises the amino acid sequence of SEQ ID NO: 6170, or a sequence having at least 70, 80, 90, 95, or 99% identity thereto.

Uses of the antibody molecules disclosed herein include but are not limited to methods of treating cancer (e.g., a cancer expressing TRBC1) disclosed herein; methods of identifying, evaluating, or selecting a subject in need of treatment (e.g., determining whether a subject has cancer cells that express TRBC1) disclosed herein; and methods of laboratory or diagnostic analysis (e.g., immunological assays comprising detecting the presence and/or level of TRBC1 or TRBC1 expressing cells).

Cytokine Molecules and Cytokine Inhibitor Molecules

Cytokines are generally polypeptides that influence cellular activity, for example, through signal transduction pathways. Accordingly, a cytokine of the multispecific or multifunctional polypeptide is useful and can be associated with receptor-mediated signaling that transmits a signal from outside the cell membrane to modulate a response within the cell. Cytokines are proteinaceous signaling compounds that are mediators of the immune response. They control many different cellular functions including proliferation, differentiation and cell survival/apoptosis; cytokines are also involved in several pathophysiological processes including viral infections and autoimmune diseases. Cytokines are synthesized under various stimuli by a variety of cells of both the innate (monocytes, macrophages, dendritic cells) and adaptive (T- and B-cells) immune systems. Cytokines can be classified into two groups: pro- and anti-inflammatory. Pro-inflammatory cytokines, including IFNγ, IL-1, IL-6 and TNF-alpha, are predominantly derived from the innate immune cells and Th1 cells. Anti-inflammatory cytokines, including IL-10, IL-4, IL-13 and IL-5, are synthesized from Th2 immune cells.

The present disclosure provides, inter alia, multispecific (e.g., bi-, tri-, quad-specific) or multifunctional molecules, that include, e.g., are engineered to contain, one or more cytokine molecules, e.g., immunomodulatory (e.g., proinflammatory) cytokines and variants, e.g., functional variants, thereof. Accordingly, in some embodiments, the cytokine molecule is an interleukin or a variant, e.g., a functional variant thereof. In some embodiments the interleukin is a proinflammatory interleukin. In some embodiments the interleukin is chosen from interleukin-2 (IL-2), interleukin-12 (IL-12), interleukin-15 (IL-15), interleukin-18 (IL-18), interleukin-21 (IL-21), interleukin-7 (IL-7), or interferon gamma. In some embodiments, the cytokine molecule is a proinflammatory cytokine.

In certain embodiments, the cytokine is a single chain cytokine. In certain embodiments, the cytokine is a multi-chain cytokine (e.g., the cytokine comprises 2 or more (e.g., 2) polypeptide chains. An exemplary multichain cytokine is IL-12.

Examples of useful cytokines include, but are not limited to, GM-CSF, IL-1α, IL-1β, IL-2, IL-3, IL-4, IL-5, IL-6, IL-7, IL-8, IL-10, IL-12, IL-21, IFN-α, IFN-β, IFN-γ, MIP-1α, MIP-1β, TGF-β, TNF-α, and TNFβ. In one embodiment the cytokine of the multispecific or multifunctional polypeptide is a cytokine selected from the group of GM-CSF, IL-2, IL-7, IL-8, IL-10, IL-12, IL-15, IL-21, IFN-α, IFN-7, MIP-1α, MIP-10 and TGF-β. In one embodiment the cytokine of the i the multispecific or multifunctional polypeptide is a cytokine selected from the group of IL-2, IL-7, IL-10, IL-12, IL-15, IFN-α, and IFN-7. In certain embodiments the cytokine is mutated to remove N- and/or O-glycosylation sites. Elimination of glycosylation increases homogeneity of the product obtainable in recombinant production.

In one embodiment, the cytokine of the multispecific or multifunctional polypeptide is IL-2. In a specific embodiment, the IL-2 cytokine can elicit one or more of the cellular responses selected from the group consisting of: proliferation in an activated T lymphocyte cell, differentiation in an activated T lymphocyte cell, cytotoxic T cell (CTL) activity, proliferation in an activated B cell, differentiation in an activated B cell, proliferation in a natural killer (NK) cell, differentiation in a NK cell, cytokine secretion by an activated T cell or an NK cell, and NK/lymphocyte activated killer (LAK) antitumor cytotoxicity. In another particular embodiment the IL-2 cytokine is a mutant IL-2 cytokine having reduced binding affinity to the .alpha.-subunit of the IL-2 receptor. Together with the .beta.- and .gamma.-subunits (also known as CD122 and CD132, respectively), the .alpha.-subunit (also known as CD25) forms the heterotrimeric high-affinity IL-2 receptor, while the dimeric receptor consisting only of the β- and γ-subunits is termed the intermediate-affinity IL-2 receptor. As described in PCT patent application number PCT/EP2012/051991, which is incorporated herein by reference in its entirety, a mutant IL-2 polypeptide with reduced binding to the .alpha.-subunit of the IL-2 receptor has a reduced ability to induce IL-2 signaling in regulatory T cells, induces less activation-induced cell death (AICD) in T cells, and has a reduced toxicity profile in vivo, compared to a wild-type IL-2 polypeptide. The use of such an cytokine with reduced toxicity is particularly advantageous in a multispecific or multifunctional polypeptide according to the invention, having a long serum half-life due to the presence of an Fc domain. In one embodiment, the mutant IL-2 cytokine of the multispecific or multifunctional polypeptide according to the invention comprises at least one amino acid mutation that reduces or abolishes the affinity of the mutant IL-2 cytokine to the .alpha.-subunit of the IL-2 receptor (CD25) but preserves the affinity of the mutant IL-2 cytokine to the intermediate-affinity IL-2 receptor (consisting of the R and 7 subunits of the IL-2 receptor), compared to the non-mutated IL-2 cytokine. In one embodiment the one or more amino acid mutations are amino acid substitutions. In a specific embodiment, the mutant IL-2 cytokine comprises one, two or three amino acid substitutions at one, two or three position(s) selected from the positions corresponding to residue 42, 45, and 72 of human IL-2. In a more specific embodiment, the mutant IL-2 cytokine comprises three amino acid substitutions at the positions corresponding to residue 42, 45 and 72 of human IL-2. In an even more specific embodiment, the mutant IL-2 cytokine is human IL-2 comprising the amino acid substitutions F42A, Y45A and L72G. In one embodiment the mutant IL-2 cytokine additionally comprises an amino acid mutation at a position corresponding to position 3 of human IL-2, which eliminates the O-glycosylation site of IL-2. Particularly, said additional amino acid mutation is an amino acid substitution replacing a threonine residue by an alanine residue. A particular mutant IL-2 cytokine useful in the invention comprises four amino acid substitutions at positions corresponding to residues 3, 42, 45 and 72 of human IL-2. Specific amino acid substitutions are T3A, F42A, Y45A and L72G. As demonstrated in PCT patent application number PCT/EP2012/051991 and in the appended Examples, said quadruple mutant IL-2 polypeptide (IL-2 qm) exhibits no detectable binding to CD25, reduced ability to induce apoptosis in T cells, reduced ability to induce IL-2 signaling in T.sub.reg cells, and a reduced toxicity profile in vivo. However, it retains ability to activate IL-2 signaling in effector cells, to induce proliferation of effector cells, and to generate IFN-γ as a secondary cytokine by NK cells.

The IL-2 or mutant IL-2 cytokine according to any of the above embodiments may comprise additional mutations that provide further advantages such as increased expression or stability. For example, the cysteine at position 125 may be replaced with a neutral amino acid such as alanine, to avoid the formation of disulfide-bridged IL-2 dimers. Thus, in certain embodiments the IL-2 or mutant IL-2 cytokine of the multispecific or multifunctional polypeptide according to the invention comprises an additional amino acid mutation at a position corresponding to residue 125 of human IL-2. In one embodiment said additional amino acid mutation is the amino acid substitution C125A.

In a specific embodiment the IL-2 cytokine of the multispecific or multifunctional polypeptide comprises the polypeptide sequence of SEQ ID NO: 7227 [APTSSSTKKTQLQLEHLLLDLQMILNGINNYKNPKL-TRMLTFKFYMPKKATELKHLQCL EEELKPLEEVLN-LAQSKNFHLRPRDLISNINVIVLELKGSETTFMCEYA-DETATIVEFLNR WITFAQSIISTLT]. In another specific embodiment the IL-2 cytokine of the multispecific or multifunctional polypeptide comprises the polypeptide sequence of SEQ ID NO: 7228

[APASSSTKKTQLQLEHULDLQMILNGINNYKNPKLTRMLTAKFAMPKKAT

LKHLQCLEEELKPLEEVLNGAQSKNFHLRPRDLISNINVIVLELKGSETTF

MCEYADETATIVEFLNRWITFAQSIISTLT].

In another embodiment the cytokine of the multispecific or multifunctional polypeptide is IL-12. In a specific embodiment said IL-12 cytokine is a single chain IL-12 cytokine. In an even more specific embodiment the single chain IL-12 cytokine comprises the polypeptide sequence of SEQ ID NO: 7229 [IWELKKDVYVVELDWYP-DAPGEMVVLTCDTPEEDGITWTLDQSSEVLGSGKTL-TIQVK EFGDAGQYTCHKGGEVLSHSLLLLHKKEDG-IWSTDILKDQKEPKNKTFLRCEAKNYSGR FTCWWLTTISTDLTFSVKSSRGSSDPQGVTCGAATL-SAERVRGDNKEYEYSVECQEDSA CPAAEE-SLPIEVMVDAVHKLKYENYTSSFFIR-DIIKPDPPKNLQLKPLKNSRQVEVSWEY PDTWSTPHSYFSLTFCVQVQGKSKREKKDRVFTDKT-SATVICRKNASISVRAQDRYYSS SWSE-WASVPCSGGGGSGGGGSGGGGSRNLP-VATPDPGMFPCLHHSQNLLRAVSNMLQ KARQTLEFYPCTSEEIDHEDITKDKTSTVEA-CLPLELTKNESCLNSRETSFITNGSCLASRK TSFM-MALCLSSIYEDLKMYQVEFKTMNAKLLMDPKRQI-FLDQNMLAVIDELMQALNFN SETVPQKSSLEEPDFYKTKIKLCILLHAFRI-RAVTIDRVMSYLNAS]. In one embodiment, the IL-12 cytokine can elicit one or more of the cellular responses selected from the group consisting of: proliferation in a NK cell, differentiation in a NK cell, proliferation in a T cell, and differentiation in a T cell.

In another embodiment the cytokine of the multispecific or multifunctional polypeptide is IL-10. In a specific embodiment said IL-10 cytokine is a single chain IL-10 cytokine. In an even more specific embodiment the single chain IL-10 cytokine comprises the polypeptide sequence of SEQ ID NO: 7230 [SPGQGTQSEN-SCTHFPGNLPNMLRDLRDAFSRVKTFFQMKDQLDN LLLKESLLEDFKG YLGCQALSEMIQFYLEEVMPQAE-NQDPDIKAHVNSLGENLKTLRLRLRRCHRFLPCENK SKAVEQVKNAFNKLQEKGIYKAMSEFDI-FINYIEAYMTMKIRNGGGGSGGGGSGGGGS GGGGSSPGQGTQSEN-SCTHFPGNLPNMLRDLRDAFSRVKTFFQMKDQLDN LLLKESLLE DFKGYLGCQALSEMI-QFYLEEVMPQAENQDPDIKAHVNSL-GENLKTLRLRLRRCHRFLP CENK-SKAVEQVKNAFNKLQEKGIYKAMSEFDIFINYIEAY MTMKIRN]. In another specific embodiment the IL-10 cytokine is a monomeric IL-10 cytokine. In a more specific embodiment the monomeric IL-10 cytokine comprises the polypeptide sequence of SEQ ID NO: [SPGQGTQSEN-SCTHFPGNLPNMLRDLRDAFSRVKTFFQMKDQLD NLLLKESLLEDFKG YLGCQALSEMI-QFYLEEVMPQAENQDPDIKAHVNSL-GENLKTLRLRLRRCHRFLPCENG GGSGGK-SKAVEQVKNAFNKLQEKGIYKAMSEFDIFINYIEAY MTMKIRN]. In one embodiment, the IL-10 cytokine can elicit one or more of the cellular responses selected from the group consisting of: inhibition of cytokine secretion, inhibition of antigen presentation by antigen presenting cells, reduction of oxygen radical release, and inhibition of T cell proliferation. A multispecific or multifunctional polypeptide according to the invention wherein the cytokine is IL-10 is particularly useful for downregulation of inflammation, e.g. in the treatment of an inflammatory disorder.

In another embodiment, the cytokine of the multispecific or multifunctional polypeptide is IL-15. In a specific embodiment said IL-15 cytokine is a mutant IL-15 cytokine having reduced binding affinity to the α-subunit of the IL-15 receptor. Without wishing to be bound by theory, a mutant IL-15 polypeptide with reduced binding to the .alpha.-subunit of the IL-15 receptor has a reduced ability to bind to fibroblasts throughout the body, resulting in improved pharmacokinetics and toxicity profile, compared to a wild-type IL-15 polypeptide. The use of an cytokine with reduced toxicity, such as the described mutant IL-2 and mutant IL-15 effector moieties, is particularly advantageous in a multispecific or multifunctional polypeptide according to the invention, having a long serum half-life due to the presence of an Fc domain. In one embodiment the mutant IL-15 cytokine of the multispecific or multifunctional polypeptide according to the invention comprises at least one amino acid mutation that reduces or abolishes the affinity of the mutant IL-15 cytokine to the .alpha.-subunit of the IL-15 receptor but preserves the affinity of the mutant IL-15 cytokine to the intermediate-affinity IL-15/IL-2 receptor (consisting of the .beta.- and .gamma.-subunits of the IL-15/IL-2 receptor), compared to the non-mutated IL-15 cytokine. In one embodiment the amino acid mutation is an amino acid substitution. In a specific embodiment, the mutant IL-15 cytokine comprises an amino acid substitution at the position corresponding to residue 53 of human IL-15. In a more specific embodiment, the mutant IL-15 cytokine is human IL-15 comprising the amino acid substitution E53A. In one embodiment the mutant IL-15 cytokine additionally comprises an amino acid mutation at a position corresponding to position 79 of human IL-15, which eliminates the N-glycosylation site of IL-15. Particularly, said additional amino acid mutation is an amino acid substitution replacing an asparagine residue by an alanine residue. In an even more specific embodiment the IL-15 cytokine comprises the polypeptide sequence of SEQ ID NO: 7232 [NWVNVISDLKKIEDLIQSMHIDATLYTESDVHPSCKVTAMKCFLLELQVISLASGDASIH DTVENLIILANNSLSSNGAVTESGCKECEELEEKNIKEFLQSFVHIVQMFINTS]. In one embodiment, the IL-15 cytokine can elicit one or more of the cellular responses selected from the group consisting of: proliferation in an activated T lymphocyte cell, differentiation in an activated T lymphocyte cell, cytotoxic T cell (CTL) activity, proliferation in an activated B cell, differentiation in an activated B cell, proliferation in a natural killer (NK) cell, differentiation in a NK cell, cytokine secretion by an activated T cell or an NK cell, and NK/lymphocyte activated killer (LAK) anti-tumor cytotoxicity.

Mutant cytokine molecules useful as effector moieties in the multispecific or multifunctional polypeptide can be prepared by deletion, substitution, insertion or modification using genetic or chemical methods well known in the art. Genetic methods may include site-specific mutagenesis of the encoding DNA sequence, PCR, gene synthesis, and the like. The correct nucleotide changes can be verified for example by sequencing. Substitution or insertion may involve natural as well as non-natural amino acid residues. Amino acid modification includes well known methods of chemical modification such as the addition or removal of glycosylation sites or carbohydrate attachments, and the like.

In one embodiment, the cytokine, particularly a single-chain cytokine, of the multispecific or multifunctional polypeptide is GM-CSF. In a specific embodiment, the GM-CSF cytokine can elicit proliferation and/or differentiation in a granulocyte, a monocyte or a dendritic cell. In one embodiment, the cytokine, particularly a single-chain cytokine, of the multispecific or multifunctional polypeptide is IFN-α. In a specific embodiment, the IFN-α cytokine can elicit one or more of the cellular responses selected from the group consisting of: inhibiting viral replication in a virus-infected cell, and upregulating the expression of major histocompatibility complex I (MHC I). In another specific embodiment, the IFN-α cytokine can inhibit proliferation in a tumor cell. In one embodiment the cytokine, particularly a single-chain cytokine, of the multispecific or multifunctional polypeptide is IFNγ. In a specific embodiment, the IFN-γ cytokine can elicit one or more of the cellular responses selected from the group of: increased macrophage activity, increased expression of MHC molecules, and increased NK cell activity. In one embodiment the cytokine, particularly a single-chain cytokine, of the multispecific or multifunctional polypeptide is IL-7. In a specific embodiment, the IL-7 cytokine can elicit proliferation of T and/or B lymphocytes. In one embodiment, the cytokine, particularly a single-chain cytokine, of the multispecific or multifunctional polypeptide is IL-8. In a specific embodiment, the IL-8 cytokine can elicit chemotaxis in neutrophils. In one embodiment, the cytokine, particularly a single-chain cytokine, of the multispecific or multifunctional polypeptide, is MIP-1α. In a specific embodiment, the MIP-1a cytokine can elicit chemotaxis in monocytes and T lymphocyte cells. In one embodiment, the cytokine, particularly a single-chain cytokine, of the multispecific or multifunctional polypeptide is MIP-1β. In a specific embodiment, the MIP-1β cytokine can elicit chemotaxis in monocytes and T lymphocyte cells. In one embodiment, the cytokine, particularly a single-chain cytokine, of the multispecific or multifunctional polypeptide is TGF-β. In a specific embodiment, the TGF-β cytokine can elicit one or more of the cellular responses selected from the group consisting of: chemotaxis in monocytes, chemotaxis in macrophages, upregulation of IL-1 expression in activated macrophages, and upregulation of IgA expression in activated B cells.

In one embodiment, the multispecific or multifunctional polypeptide of the invention binds to an cytokine receptor with a dissociation constant ($K_D$) that is at least about 1, 1.5, 2, 2.5, 3, 3.5, 4, 4.5, 5, 5.5, 6, 6.5, 7, 7.5, 8, 8.5, 9, 9.5 or 10 times greater than that for a control cytokine. In another embodiment, the multispecific or multifunctional polypeptide binds to an cytokine receptor with a $K_D$ that is at least 2, 3, 4, 5, 6, 7, 8, 9, or 10 times greater than that for a corresponding multispecific or multifunctional polypeptide comprising two or more effector moieties. In another embodiment, the multispecific or multifunctional polypeptide binds to an cytokine receptor with a dissociation constant $K_D$ that is about 10 times greater than that for a corresponding the multispecific or multifunctional polypeptide comprising two or more cytokines.

In some embodiments, the multispecific molecules disclosed herein include a cytokine molecule. In embodiments, the cytokine molecule includes a full length, a fragment or a variant of a cytokine; a cytokine receptor domain, e.g., a cytokine receptor dimerizing domain; or an agonist of a cytokine receptor, e.g., an antibody molecule (e.g., an agonistic antibody) to a cytokine receptor.

In some embodiments the cytokine molecule is chosen from IL-2, IL-12, IL-15, IL-18, IL-7, IL-21, or interferon gamma, or a fragment or variant thereof, or a combination of any of the aforesaid cytokines. The cytokine molecule can be a monomer or a dimer. In embodiments, the cytokine molecule can further include a cytokine receptor dimerizing domain.

In other embodiments, the cytokine molecule is an agonist of a cytokine receptor, e.g., an antibody molecule (e.g., an agonistic antibody) to a cytokine receptor chosen from an IL-15Ra or IL-21R.

In one embodiment, the cytokine molecule is IL-15, e.g., human IL-15 (e.g., comprising the amino acid sequence: NWVNVISDLKKIEDLIQSMHIDATLYTESDVHP-SCKVTAMKCFLLELQVISLESGDASIH DTVEN-LIILANNSLSSNGNVTESGCKECEELEEKNIKE-FLQSFVHIVQMFINTS (SEQ ID NO: 7017), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7017.

In some embodiments, the cytokine molecule comprises a receptor dimerizing domain, e.g., an IL15Ralpha dimerizing domain. In one embodiment, the IL15Ralpha dimerizing domain comprises the amino acid sequence: MAPR-RARGCRTLGLPALLLLLLLRPPATRGITCPPPMSVE-HADIWVKSYSLYSRERYICN SGFKRKAGTSSLTECVL (SEQ ID NO: 7018), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7018. In some embodiments, the cytokine molecule (e.g., IL-15) and the receptor dimerizing domain (e.g., an IL15Ralpha dimerizing domain) of the multispecific molecule are covalently linked, e.g., via a linker (e.g., a Gly-Ser linker, e.g., a linker comprising the amino acid sequence SGGSGGGGSGGGSGGGGSLQ (SEQ ID NO: 7019). In other embodiments, the cytokine molecule (e.g., IL-15) and the receptor dimerizing domain (e.g., an IL15Ralpha dimerizing domain) of the multispecific molecule are not covalently linked, e.g., are non-covalently associated.

In other embodiments, the cytokine molecule is IL-2, e.g., human IL-2 (e.g., comprising the amino acid sequence: APTSSSTKKTQLQLEHLLLDLQMILNGINNYKNPKL-TRMLTFKFYMPKKATELKHLQCL EEELKPLEEVLN-LAQSKNFHLRPRDLISNINVIVLELKGSETTFMCEYA-DETATIVEFLNR WITFCQSIISTLT (SEQ ID NO: 7020), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7020).

In other embodiments, the cytokine molecule is IL-18, e.g., human IL-18 (e.g., comprising the amino acid sequence: YFGKLESKLSVIRNLNDQVLFIDQGNR-PLFEDMTDSDCRDNAPRTIFIISMYKDSQPRGM AVTISVKCEKISTLSCENKIISFKEMNPPDNIKDTKS-DIIFFQRSVPGHDNKMQFESSSYEG YFLACEKER-DLFKLILKKEDELGDRSIMFTVQNED (SEQ ID NO: 7021), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7021).

In other embodiments, the cytokine molecule is IL-21, e.g., human IL-21 (e.g., comprising the amino acid sequence: QGQDRHMIRMRQLIDI-VDQLKNYVNDLVPEFLPAPEDVETNCEWS-AFSCFQKAQLKSA NTGNNERIINVSIKKLKRKPPST-NAGRRQKHRLTCPSCDSYEKKPPKEFLERFKSLLQK MI HQHLSSRTHGSEDS (SEQ ID NO: 7022), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7022).

In yet other embodiments, the cytokine molecule is interferon gamma, e.g., human interferon gamma (e.g., comprising the amino acid sequence: QDPYVKEAE-NLKKYFNAGHSDVADNGTLFLGILKNWKEESDRKI MQSQIVSFYFKLFK NFKDDQSIQKSVE-TIKEDMNVKFFNSNKKKRDDFEKLT-NYSVTDLNVQRKAIHELIQVM AELSPAAKTGKRKR-SQMLFRG (SEQ ID NO: 7023), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7023).

TGF-Beta Inhibitors

The present disclosure further provides, inter alia, multispecific (e.g., bi-, tri-, quad-specific) or multifunctional molecules, that include, e.g., are engineered to contain, one or more cytokine inhibitor molecules, e.g., inhibitors of immunomodulatory (e.g., proinflammatory) cytokines and variants, e.g., functional variants, thereof. Accordingly, in some embodiments, the cytokine inhibitor molecule is a TGF-beta inhibitor. In some embodiments, the TGF-beta inhibitor binds to and inhibits TGF-beta, e.g., reduces the activity of TGF-beta. In some embodiments, the TGF-beta inhibitor inhibits (e.g., reduces the activity of) TGF-beta 1. In some embodiments, the TGF-beta inhibitor inhibits (e.g., reduces the activity of) TGF-beta 2. In some embodiments, the TGF-beta inhibitor inhibits (e.g., reduces the activity of) TGF-beta 3. In some embodiments, the TGF-beta inhibitor inhibits (e.g., reduces the activity of) TGF-beta 1 and TGF-beta 3. In some embodiments, the TGF-beta inhibitor inhibits (e.g., reduces the activity of) TGF-beta 1, TGF-beta 2, and TGF-beta 3.

In some embodiments, the TGF-beta inhibitor comprises a portion of a TGF-beta receptor (e.g., an extracellular domain of a TGF-beta receptor) that is capable of inhibiting (e.g., reducing the activity of) TGF-beta, or functional fragment or variant thereof. In some embodiments, the TGF-beta inhibitor comprises a TGFBR1 polypeptide (e.g., an extracellular domain of TGFBR1 or functional variant thereof). In some embodiments, the TGF-beta inhibitor comprises a TGFBR2 polypeptide (e.g., an extracellular domain of TGFBR2 or functional variant thereof). In some embodiments, the TGF-beta inhibitor comprises a TGFBR3 polypeptide (e.g., an extracellular domain of TGFBR3 or functional variant thereof). In some embodiments, the TGF-beta inhibitor comprises a TGFBR1 polypeptide (e.g., an extracellular domain of TGFBR1 or functional variant thereof) and a TGFBR2 polypeptide (e.g., an extracellular domain of TGFBR2 or functional variant thereof). In some embodiments, the TGF-beta inhibitor comprises a TGFBR1 polypeptide (e.g., an extracellular domain of TGFBR1 or functional variant thereof) and a TGFBR3 polypeptide (e.g., an extracellular domain of TGFBR3 or functional variant thereof). In some embodiments, the TGF-beta inhibitor comprises a TGFBR2 polypeptide (e.g., an extracellular domain of TGFBR2 or functional variant thereof) and a TGFBR3 polypeptide (e.g., an extracellular domain of TGFBR3 or functional variant thereof).

Exemplary TGF-beta receptor polypeptides that can be used as TGF-beta inhibitors have been disclosed in U.S. Pat. Nos. 8,993,524, 9,676,863, 8,658,135, US20150056199, US20070184052, and WO2017037634, all of which are herein incorporated by reference in their entirety.

In some embodiments, the TGF-beta inhibitor comprises an extracellular domain of TGFBR1 or a sequence substantially identical thereto (e.g., a sequence that is at least 80%, 85%, 90%, or 95% identical thereto). In some embodiments, the TGF-beta inhibitor comprises an extracellular domain of SEQ ID NO: 95, or a sequence substantially identical thereto (e.g., a sequence that is at least 80%, 85%, 90%, or 95% identical thereto). In some embodiments, the TGF-beta inhibitor comprises an extracellular domain of SEQ ID NO: 96, or a sequence substantially identical thereto (e.g., a sequence that is at least 80%, 85%, 90%, or 95% identical thereto). In some embodiments, the TGF-beta inhibitor comprises an extracellular domain of SEQ ID NO: 97, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 104, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 105, or a sequence substantially identical thereto (e.g., a sequence that is at least 80%, 85%, 90%, or 95% identical thereto).

In some embodiments, the TGF-beta inhibitor comprises an extracellular domain of TGFBR2 or a sequence substantially identical thereto (e.g., a sequence that is at least 80%, 85%, 90%, or 95% identical thereto). In some embodiments, the TGF-beta inhibitor comprises an extracellular domain of SEQ ID NO: 98, or a sequence substantially identical thereto (e.g., a sequence that is at least 80%, 85%, 90%, or 95% identical thereto). In some embodiments, the TGF-beta inhibitor comprises an extracellular domain of SEQ ID NO: 99, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 100, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 101, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 102, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 103, or a sequence substantially identical thereto (e.g., a sequence that is at least 80%, 85%, 90%, or 95% identical thereto).

In some embodiments, the TGF-beta inhibitor comprises an extracellular domain of TGFBR3 or a sequence substantially identical thereto (e.g., a sequence that is at least 80%, 85%, 90%, or 95% identical thereto). In some embodiments, the TGF-beta inhibitor comprises an extracellular domain of SEQ ID NO: 106, or a sequence substantially identical thereto (e.g., a sequence that is at least 80%, 85%, 90%, or 95% identical thereto). In some embodiments, the TGF-beta inhibitor comprises an extracellular domain of SEQ ID NO: 107, or a sequence substantially identical thereto (e.g., a sequence that is at least 80%, 85%, 90%, or 95% identical thereto). In some embodiments, the TGF-beta inhibitor comprises the amino acid sequence of SEQ ID NO: 108, or a sequence substantially identical thereto (e.g., a sequence that is at least 80%, 85%, 90%, or 95% identical thereto).

In some embodiments, the TGF-beta inhibitor comprises no more than one TGF-beta receptor extracellular domain. In some embodiments, the TGF-beta inhibitor comprises two or more (e.g., two, three, four, five, or more) TGF-beta receptor extracellular domains, linked together, e.g., via a linker.

TABLE 16

Exemplary amino acid sequences of TGF-beta polypeptides or TGF-beta receptor polypeptides

| SEQ ID NO | Description | Amino acid sequence |
|---|---|---|
| SEQ ID NO: 92 | Immature human TGF-beta 1 (P01137-1) | MPPSGLRLLLLLLPLLWLLVLTPGRPAAGLSTCKTIDMELVKRKRIEA IRGQILSKLRLASPPSQGEVPPGPLPEAVLALYNSTRDRVAGESAEPEP EPEADYYAKEVTRVLMVETHNEIYDKFKQSTHSIYMFFNTSELREAV PEPVLLSRAELRLLRLKLKVEQHVELYQKYSNNSWRYLSNRLLAPSD SPEWLSFDVTGVVRQWLSRGGEIEGFRLSAHCSCDSRDNTLQVDING FTTGRRGDLATIHGMNRPFLLLMATPLERAQHLQSSRHRRALDTNYC FSSTEKNCCVRQLYIDFRKDLGWKWIHEPKGYHANFCLGPCPYIWSL DTQYSKVLALYNQHNPGASAAPCCVPQALEPLPIVYYVGRKPKVEQ LSNMIVRSCKCS |
| SEQ ID NO: 117 | Human TGF-beta 1 (P01137-1) | LSTCKTIDMELVKRKRIEAIRGQILSKLRLASPPSQGEVPPGPLPEAVL ALYNSTRDRVAGESAEPEPEPEADYYAKEVTRVLMVETHNEIYDKF KQSTHSIYMFFNTSELREAVPEPVLLSRAELRLLRLKLKVEQHVELYQ KYSNNSWRYLSNRLLAPSDSPEWLSFDVTGVVRQWLSRGGEIEGFRL SAHCSCDSRDNTLQVDINGFTTGRRGDLATIHGMNRPFLLLMATPLE RAQHLQSSRHRRALDTNYCFSSTEKNCCVRQLYIDFRKDLGWKWIH EPKGYHANFCLGPCPYIWSLDTQYSKVLALYNQHNPGASAAPCCVP QALEPLPIVYYVGRKPKVEQLSNMIVRSCKCS |
| SEQ ID NO: 93 | Immature human TGF-beta 2 (P61812-1) | MHYCVLSAFLILHLVTVALSLSTCSTLDMDQFMRKRIEAIRGQILSKL KLTSPPEDYPEPEEVPPEVISIYNSTRDLLQEKASRRAAACERERSDEE YYAKEVYKIDMPPFFPSENAIPPTFYRPYFRIVRFDVSAMEKNASNLV KAEFRVFRLQNPKARVPEQRIELYQILKSKDLTSPTQRYIDSKVVKTR AEGEWLSFDVTDAVHEWLHHKDRNLGFKISLHCPCCTFVPSNNYIIP NKSEELEARFAGIDGTSTYTSGDQKTIKSTRKKNSGKTPHLLLMLLPS YRLESQQTNRRKKRALDAAYCFRNVQDNCCLRPLYIDFKRDLGWK WIHEPKGYNANFCAGACPYLWSSDTQHSRVLSLYNTINPEASASPCC VSQDLEPLTILYYIGKTPKIEQLSNMIVKSCKCS |
| SEQ ID NO: 118 | Human TGF-beta 2 (P61812-1) | LSTCSTLDMDQFMRKRIEAIRGQILSKLKLTSPPEDYPEPEEVPPEVISI YNSTRDLLQEKASRRAAACERERSDEEYYAKEVYKIDMPPFFPSENA IPPTFYRPYFRIVRFDVSAMEKNASNLVKAEFRVFRLQNPKARVPEQR IELYQILKSKDLTSPTQRYIDSKVVKTRAEGEWLSFDVTDAVHEWLH HKDRNLGFKISLHCPCCTFVPSNNYIIPNKSEELEARFAGIDGTSTYTS GDQKTIKSTRKKNSGKTPHLLLMLLPSYRLESQQTNRRKKRALDAA YCFRNVQDNCCLRPLYIDFKRDLGWKWIHEPKGYNANFCAGACPYL |

TABLE 16-continued

Exemplary amino acid sequences of TGF-beta polypeptides or TGF-beta receptor polypeptides

| SEQ ID NO | Description | Amino acid sequence |
|---|---|---|
| | | WSSDTQHSRVLSLYNTINPEASASPCCVSQDLEPLTILYYIGKTPKIEQ LSNMIVKSCKCS |
| SEQ ID NO: 94 | Immature human TGF-beta 3 (P10600-1) | MKMHLQRALVVLALLNFATVSLSLSTCTTLDFGHIKKKRVEAIRGQI LSKLRLTSPPEPTVMTHVPYQVLALYNSTRELLEEMHGEREEGCTQE NTESEYYAKEIHKFDMIQGLAEHNELAVCPKGITSKVFRFNVSSVEK NRTNLFRAEFRVLRVPNPSSKRNEQRIELFQILRPDEHIAKQRYIGGK NLPTRGTAEWLSFDVTDTVREWLLRRESNLGLEISIHCPCHTFQPNGD ILENIHEVMEIKFKGVDNEDDHGRGDLGRLKKQKDFIHNPHLILMMIP PHRLDNPGQGGQRKKRALDTNYCFRNLEENCCVRPLYIDFRQDLGW KWVHEPKGYYANFCSGPCPYLRSADTTHSTVLGLYNTLNPEASASPC CVPQDLEPLTILYYVGRTPKVEQLSNMVVKSCKCS |
| SEQ ID NO: 119 | Human TGF-beta 3 (P10600-1) | LSTCTTLDFGHIKKKRVEAIRGQILSKLRLTSPPEPTVMTHVPYQVLA LYNSTRELLEEMHGEREEGCTQENTESEYYAKEIHKFDMIQGLAEHN ELAVCPKGITSKVFRFNVSSVEKNRTNLFRAEFRVLRVPNPSSKRNEQ RIELFQILRPDEHIAKQRYIGGKNLPTRGTAEWLSFDVTDTVREWLLR RESNLGLEISIHCPCHTFQPNGDILENIHEVMEIKFKGVDNEDDHGRG DLGRLKKQKDFIHNPHLILMMIPPHRLDNPGQGGQRKKRALDTNYCF RNLEENCCVRPLYIDFRQDLGWKWVHEPKGYYANFCSGPCPYLRSA DTTHSTVLGLYNTLNPEASASPCCVPQDLEPLTILYYVGRTPKVEQLS NMVVKSCKCS |
| SEQ ID NO: 95 | Immature human TGFBR1 isoform 1 (P36897-1) | MEAAVAAPRPRLLLLVLAAAAAAAALLPGATALQCFCHLCTKDNF TCVTDGLCFVSVTETTDKVIHNSMCIAEIDLIPRDRPFVCAPSSKTGSV TTTYCCNQDHCNKIELPTTVKSSPGLGPVELAAVIAGPVCFVCISLML MVYICHNRTVIFIHRVPNEEDPSLDRPFISEGTTLKDLIYDMTTSGSGS GLPLLVQRTIARTIVLQESIGKGRFGEVWRGKWRGEEVAVKIFSSREE RSWFREAEIYQTVMLRHENILGFIAADNKDNGTWTQLWLVSDYHEH GSLFDYLNRYTVTVEGMIKLALSTASGLAHLHMEIVGTQGKPAIAHR DLKSKNILVKKNGTCCIADLGLAVRHDSATDTIDIAPNHRVGTKRYM APEVLDDSINMKHFESFKRADIYAMGLVFWEIARRCSIGGIHEDYQLP YYDLVPSDPSVEEMRKVVCEQKLRPNIPNRWQSCEALRVMAKIMRE CWYANGAARLTALRIKKTLSQLSQQEGIKM |
| SEQ ID NO: 120 | Human TGFBR1 isoform 1 (P36897-1) | LQCFCHLCTKDNFTCVTDGLCFVSVTETTDKVIHNSMCIAEIDLIPRD RPFVCAPSSKTGSVTTTYCCNQDHCNKIELPTTVKSSPGLGPVELAAV IAGPVCFVCISLMLMVYICHNRTVIHHRVPNEEDPSLDRPFISEGTTLK DLIYDMTTSGSGSGLPLLVQRTIARTIVLQESIGKGRFGEVWRGKWR GEEVAVKIFSSREERSWFREAEIYQTVMLRHENILGFIAADNKDNGT WTQLWLVSDYHEHGSLFDYLNRYTVTVEGMIKLALSTASGLAHLH MEIVGTQGKPAIAHRDLKSKNILVKKNGTCCIADLGLAVRHDSATDT IDIAPNHRVGTKRYMAPEVLDDSINMKHFESFKRADIYAMGLVFWEI ARRCSIGGIHEDYQLPYYDLVPSDPSVEEMRKVVCEQKLRPNIPNRW QSCEALRVMAKIMRECWYANGAARLTALRIKKTLSQLSQQEGIKM |
| SEQ ID NO: 96 | Immature human TGFBR1 isoform 2 (P36897-2) | MEAAVAAPRPRLLLLVLAAAAAAAALLPGATALQCFCHLCTKDNF TCVTDGLCFVSVTETTDKVIHNSMCIAEIDLIPRDRPFVCAPSSKTGSV TTTYCCNQDHCNKIELPTTGPFSVKSSPGLGPVELAAVIAGPVCFVCIS LMLMVYICHNRTVIFIHRVPNEEDPSLDRPFISEGTTLKDLIYDMTTSG SGSGLPLLVQRTIARTIVLQESIGKGRFGEVWRGKWRGEEVAVKIFSS REERSWFREAEIYQTVMLRHENILGFIAADNKDNGTWTQLWLVSDY HEHGSLFDYLNRYTVTVEGMIKLALSTASGLAHLHMEIVGTQGKPAI AHRDLKSKNILVKKNGTCCIADLGLAVRHDSATDTIDIAPNHRVGTK RYMAPEVLDDSINMKHFESFKRADIYAMGLVFWEIARRCSIGGIHED YQLPYYDLVPSDPSVEEMRKVVCEQKLRPNIPNRWQSCEALRVMAK IMRECWYANGAARLTALRIKKTLSQLSQQEGIKM |
| SEQ ID NO: 121 | Human TGFBR1 isoform 2 (P36897-2) | LQCFCHLCTKDNFTCVTDGLCFVSVTETTDKVIHNSMCIAEIDLIPRD RPFVCAPSSKTGSVTTTYCCNQDHCNKIELPTTGPFSVKSSPGLGPVE LAAVIAGPVCFVCISLMLMVYICHNRTVIFIHRVPNEEDPSLDRPFISE GTTLKDLIYDMTTSGSGSGLPLLVQRTIARTIVLQESIGKGRFGEVWR GKWRGEEVAVKIFSSREERSWFREAEIYQTVMLRHENILGFIAADNK DNGTWTQLWLVSDYHEHGSLFDYLNRYTVTVEGMIKLALSTASGLA HLHMEIVGTQGKPAIAHRDLKSKNILVKKNGTCCIADLGLAVRHDSA TDTIDIAPNHRVGTKRYMAPEVLDDSINMKHFESFKRADIYAMGLVF WEIARRCSIGGIHEDYQLPYYDLVPSDPSVEEMRKVVCEQKLRPNIPN RWQSCEALRVMAKIMRECWYANGAARLTALRIKKTLSQLSQQEGIKM |
| SEQ ID NO: 97 | Immature human TGFBR1 isoform 3 (P36897-3) | MEAAVAAPRPRLLLLVLAAAAAAAALLPGATALQCFCHLCTKDNF TCVTDGLCFVSVTETTDKVIHNSMCIAEIDLIPRDRPFVCAPSSKTGSV TTTYCCNQDHCNKIELPTTGLPLLVQRTIARTIVLQESIGKGRFGEVW RGKWRGEEVAVKIFSSREERSWFREAEIYQTVMLRHENILGFIAADN KDNGTWTQLWLVSDYHEHGSLFDYLNRYTVTVEGMIKLALSTASGL |

TABLE 16-continued

Exemplary amino acid sequences of TGF-beta polypeptides or TGF-beta receptor polypeptides

| SEQ ID NO | Description | Amino acid sequence |
|---|---|---|
| | | AHLHMEIVGTQGKPAIAHRDLKSKNILVKKNGTCCIADLGLAVRHDS ATDTIDIAPNHRVGTKRYMAPEVLDDSINMKHFESFKRADIYAMGLV FWEIARRCSIGGIHEDYQLPYYDLVPSDPSVEEMRKVVCEQKLRPNIP NRWQSCEALRVMAKIMRECWYANGAARLTALRIKKTLSQLSQQEGIKM |
| SEQ ID NO: 122 | Human TGFBR1 isoform 3 (P36897-3) | LQCFCHLCTKDNFTCVTDGLCFVSVTETTDKVIHNSMCIAEIDLIPRD RPFVCAPSSKTGSVTTTYCCNQDHCNKIELPTTGLPLLVQRTIARTIVL QESIGKGRFGEVWRGKWRGEEVAVKIFSSREERSWFREAEIYQTVML RHENILGFIAADNKDNGTWTQLWLVSDYHEGSLFDYLNRYTVTVE GMIKLALSTASGLAHLHMEIVGTQGKPAIAHRDLKSKNILVKKNGTC CIADLGLAVRHDSATDTIDIAPNHRVGTKRYMAPEVLDDSINMKHFE SFKRADIYAMGLVFWEIARRCSIGGIHEDYQLPYYDLVPSDPSVEEM RKVVCEQKLRPNIPNRWQSCEALRVMAKIMRECWYANGAARLTAL RIKKTLSQLSQQEGIKM |
| SEQ ID NO: 104 | Human TGFBR1 fragment 1 | LQCFCHLCTKDNFTCVTDGLCFVSVTETTDKVIHNSMCIAEIDLIPRD RPFVCAPSSKTGSVTTTYCCNQDHCNKIELPTTVKSSPGLGPVEL |
| SEQ ID NO: 105 | Human TGFBR1 fragment 2 | ALQCFCHLCTKDNFTCVTDGLCFVSVTETTDKVIHNSMCIAEIDLIPR DRPFVCAPSSKTGSVTTTYCCNQDHCNKIEL |
| SEQ ID NO: 98 | Immature human TGFBR2 isoform B (short isoform) (P37173-1) | MGRGLLRGLWPLHIVLWTRIASTIPPHVQKSVNNDMIVTDNNGAVK FPQLCKFCDVRFSTCDNQKSCMSNCSITSICEKPQEVCVAVWRKNDE NITLETVCHDPKLPYHDFILEDAASPKCIMKEKKKPGETFFMCSCSSD ECNDNIIFSEEYNTSNPDLLLVIFQVTGISLLPPLGVAISVIIIFYCYRV NRQQKLSSTWETGKTRKLMEFSEHCAIILEDDRSDISSTCANNINHTE LLPIELDTLVGKGRFAEVYKAKLKQNTSEQFETVAVKIFPYEEYASW KTEKDIFSDINLKHENILQFLTAEERKTELGKQYWLITAFHAKGNLQE YLTRHVISWEDLRKLGSSLARGIAHLHSDHTPCGRPKMPIVHRDLKS SNILVKNDLTCCLCDFGLSLRLDPTLSVDDLANSGQVGTARYMAPEV LESRMNLENVESFKQTDVYSMALVLWEMTSRCNAVGEVKDYEPPF GSKVREHPCVESMKDNVLRDRGRPEIPSFWLNHQGIQMVCETLTEC WDHDPEARLTAQCVAERFSELEHLDRLSGRSCSEEKIPEDGSLNTTK |
| SEQ ID NO: 123 | Human TGFBR2 isoform B (short isoform) (P37173-1) | TIPPHVQKSVNNDMIVTDNNGAVKFPQLCKFCDVRFSTCDNQKSCM SNCSITSICEKPQEVCVAVWRKNDENITLETVCHDPKLPYHDFILEDA ASPKCIMKEKKKPGETFFMCSCSSDECNDNIIFSEEYNTSNPDLLLVIF QVTGISLLPPLGVAISVIIIFYCYRVNRQQKLSSTWETGKTRKLMEFSE HCAIILEDDRSDISSTCANNINHNTELLPIELDTLVGKGRFAEVYKAKL KQNTSEQFETVAVKIFPYEEYASWKTEKDIFSDINLKHENILQFLTAE ERKTELGKQYWLITAFHAKGNLQEYLTRHVISWEDLRKLGSSLARGI AHLHSDHTPCGRPKMPIVHRDLKSSNILVKNDLTCCLCDFGLSLRLD PTLSVDDLANSGQVGTARYMAPEVLESRMNLENVESFKQTDVYSM ALVLWEMTSRCNAVGEVKDYEPPFGSKVREHPCVESMKDNVLRDR GRPEIPSFWLNHQGIQMVCETLTECWDHDPEARLTAQCVAERFSELE HLDRLSGRSCSEEKIPEDGSLNTTK |
| SEQ ID NO: 99 | Immature human TGFBR2 isoform A (long isoform) (P37173-2) | MGRGLLRGLWPLHIVLWTRIASTIPPHVQKSDVEMEAQKDEIICPSCN RTAHPLRHINNDMIVTDNNGAVKFPQLCKFCDVRFSTCDNQKSCMS NCSITSICEKPQEVCVAVWRKNDENITLETVCHDPKLPYHDFILEDAA SPKCIMKEKKKPGETFFMCSCSSDECNDNIIFSEEYNTSNPDLLLVIFQ VTGISLLPPLGVAISVIIIFYCYRVNRQQKLSSTWETGKTRKLMEFSEH CAIILEDDRSDISSTCANNINHNTELLPIELDTLVGKGRFAEVYKAKLK QNTSEQFETVAVKIFPYEEYASWKTEKDIFSDINLKHENILQFLTAEER KTELGKQYWLITAFHAKGNLQEYLTRHVISWEDLRKLGSSLARGIAH LHSDHTPCGRPKMPIVHRDLKSSNILVKNDLTCCLCDFGLSLRLDPTL SVDDLANSGQVGTARYMAPEVLESRMNLENVESFKQTDVYSMALV LWEMTSRCNAVGEVKDYEPPFGSKVREHPCVESMKDNVLRDRGRP EIPSFWLNHQGIQMVCETLTECWDHDPEARLTAQCVAERFSELEHLD RLSGRSCSEEKIPEDGSLNTTK |
| SEQ ID NO: 124 | Human TGFBR2 isoform A (long isoform) (P37173-2) | TIPPHVQKSDVEMEAQKDEIICPSCNRTAHPLRHINNDMIVTDNNGA VKFPQLCKFCDVRFSTCDNQKSCMSNCSITSICEKPQEVCVAVWRKN DENITLETVCHDPKLPYHDFILEDAASPKCIMKEKKKPGETFFMCSCS SDECNDNIIFSEEYNTSNPDLLLVIFQVTGISLLPPLGVAISVIIIFYCY RVNRQQKLSSTWETGKTRKLMEFSEHCAIILEDDRSDISSTCANNINH TELLPIELDTLVGKGRFAEVYKAKLKQNTSEQFETVAVKIFPYEEYAS WKTEKDIFSDINLKHENILQFLTAEERKTELGKQYWLITAFHAKGNL QEYLTRHVISWEDLRKLGSSLARGIAHLHSDHTPCGRPKMPIVHRDL KSSNILVKNDLTCCLCDFGLSLRLDPTLSVDDLANSGQVGTARYMAP EVLESRMNLENVESFKQTDVYSMALVLWEMTSRCNAVGEVKDYEP |

TABLE 16-continued

Exemplary amino acid sequences of TGF-beta polypeptides or TGF-beta receptor polypeptides

| SEQ ID NO | Description | Amino acid sequence |
|---|---|---|
| | | PFGSKVREHPCVESMKDNVLRDRGRPEIPSFWLNHQGIQMVCETLTE<br>CWDHDPEARLTAQCVAERFSELEHLDRLSGRSCSEEKIPEDGSLNTTK |
| SEQ ID NO: 100 | Human TGFBR2 fragment 1 (ECD of human TGFBR2 isoform B) | TIPPHVQKSVNNDMIVTDNNGAVKFPQLCKFCDVRFSTCDNQKSCM<br>SNCSITSICEKPQEVCVAVWRKNDENITLETVCHDPKLPYHDFILEDA<br>ASPKCIMKEKKKPGETFFMCSCSSDECNDNIIFSEEYNTSNPD |
| SEQ ID NO: 101 | Human TGFBR2 fragment 2 | IPPHVQKSVNNDMIVTDNNGAVKFPQLCKFCDVRFSTCDNQKSCMS<br>NCSITSICEKPQEVCVAVWRKNDENITLETVCHDPKLPYHDFILEDAA<br>SPKCIMKEKKKPGETFFMCSCSSDECNDNIIFSEEYNTSNPD |
| SEQ ID NO: 102 | Human TGFBR2 fragment 3 (ECD of human TGFBR2 isoform A) | TIPPHVQKSDVEMEAQKDEIICPSCNRTAHPLRHINNDMIVTDNNGA<br>VKFPQLCKFCDVRFSTCDNQKSCMSNCSITSICEKPQEVCVAVWRKN<br>DENITLETVCHDPKLPYHDFILEDAASPKCIMKEKKKPGETFFMCSCS<br>SDECNDNIIFSEEYNTSNPD |
| SEQ ID NO: 103 | Human TGFBR2 fragment 4 | QLCKFCDVRFSTCDNQKSCMSNCSITSICEKPQEVCVAVWRKNDENI<br>TLETVCHDPKLPYHDFILEDAASPKCIMKEKKKPGETFFMCSCSSDEC<br>NDNIIF |
| SEQ ID NO: 106 | Immature human TGFBR3 isoform 1 (Q03167-1) | MTSHYVIAIFALMSSCLATAGPEPGALCELSPVSASHPVQALMESFTV<br>LSGCASRGTTGLPQEVHVLNLRTAGQGPGQLQREVTLHLNPISSVHI<br>HFIKSVVFLLNSPHPLVWHLKTERLATGVSRLFLVSEGSVVQFSSANF<br>SLTAETEERNFPHGNEHLLNWARKEYGAVTSFTELKIARNIYIKVGE<br>DQVFPPKCNIGKNFLSLNYLAEYLQPKAAEGCVMSSQPQNEEVHIIEL<br>ITPNSNPYSAFQVDITIDIRPSQEDLEVVKNLILILKCKKSVNWVIKSFD<br>VKGSLKIIAPNSIGFGKESERSMTMTKSIRDDIPSTQGNLVKWALDNG<br>YSPITSYTMAPVANRFHLRLENNAEEMGDEEVHTIPPELRILLDPGAL<br>PALQNPPIRGGEGQNGGLPFPFPPDISRRVWNEEGEDGLPRPKDPVIPSI<br>QLFPGLREPEEVQGSVDIALSVKCDNEKMIVAVEKDSFQASGYSGMD<br>VTLLDPTCKAKMNGTHFVLESPLNGCGTRPRWSALDGVVYYNSIVI<br>QVPALGDSSGWPDGYEDLESGDNGFPGDMDEGDASLFTRPEIVVFN<br>CSLQQVRNPSSFQEQPHGNITFNMELYNTDLFLVPSQGVFSVPENGH<br>VYVEVSVTKAEQELGFAIQTCFISPYSNPDRMSHYTIIENICPKDESVK<br>FYSPKRVHFPIPQADMDKKRFSFVFKPVFNTSLLFLQCELTLCTKMEK<br>HPQKLPKCVPPDEACTSLDASIIWAMMQNKKTFTKPLAVIHHEAESK<br>EKGPSMKEPNPISPPIFHGLDTLTVMGIAFAAFVIGALLTGALWYWS<br>HTGETAGRQQVPTSPPASENSSAAHSIGSTQSTPCSSSSTA |
| SEQ ID NO: 125 | Human TGFBR3 isoform 1 (Q03167-1) | GPEPGALCELSPVSASHPVQALMESFTVLSGCASRGTTGLPQEVHVL<br>NLRTAGQGPGQLQREVTLHLNPISSVHIFIHKSVVFLLNSPHPLVWHL<br>KTERLATGVSRLFLVSEGSVVQFSSANFSLTAETEERNFPHGNEHLLN<br>WARKEYGAVTSFTELKIARNIYIKVGEDQVFPPKCNIGKNFLSLNYLA<br>EYLQPKAAEGCVMSSQPQNEEVHIIELITPNSNPYSAFQVDITIDIRPSQ<br>EDLEVVKNLILILKCKKSVNWVIKSFDVKGSLKIIAPNSIGFGKESERS<br>MTMTKSIRDDIPSTQGNLVKWALDNGYSPITSYTMAPVANRFHLRLE<br>NNAEEMGDEEVHTIPPELRILLDPGALPALQNPPIRGGEGQNGGLPFP<br>FPPDISRRVWNEEGEDGLPRPKDPVIPSIQLFPGLREPEEVQGSVDIALS<br>VKCDNEKMIVAVEKDSFQASGYSGMDVTLLDPTCKAKMNGTHFVL<br>ESPLNGCGTRPRWSALDGVVYYNSIVIQVPALGDSSGWPDGYEDLES<br>GDNGFPGDMDEGDASLFTRPEIVVFNCSLQQVRNPSSFQEQPHGNITF<br>NMELYNTDLFLVPSQGVFSVPENGHVYVEVSVTKAEQELGFAIQTCF<br>ISPYSNPDRMSHYTIIENICPKDESVKFYSPKRVHFPIPQADMDKKRFS<br>FVFKPVFNTSLLFLQCELTLCTKMEKHPQKLPKCVPPDEACTSLDASII<br>WAMMQNKKTFTKPLAVIHHEAESKEKGPSMKEPNPISPPIFHGLDTL<br>TVMGIAFAAFVIGALLTGALWYIYSHTGETAGRQQVPTSPPASENSS<br>AAHSIGSTQSTPCSSSSTA |
| SEQ ID NO: 107 | Immature human TGFBR3 isoform 2 (Q03167-2) | MTSHYVIAIFALMSSCLATAGPEPGALCELSPVSASHPVQALMESFTV<br>LSGCASRGTTGLPQEVHVLNLRTAGQGPGQLQREVTLHLNPISSVHI<br>HFIKSVVFLLNSPHPLVWHLKTERLATGVSRLFLVSEGSVVQFSSANF<br>SLTAETEERNFPHGNEHLLNWARKEYGAVTSFTELKIARNIYIKVGE<br>DQVFPPKCNIGKNFLSLNYLAEYLQPKAAEGCVMSSQPQNEEVHIIEL<br>ITPNSNPYSAFQVDITIDIRPSQEDLEVVKNLILILKCKKSVNWVIKSFD<br>VKGSLKIIAPNSIGFGKESERSMTMTKSIRDDIPSTQGNLVKWALDNG<br>YSPITSYTMAPVANRFHLRLENNEEMGDEEVHTIPPELRILLDPGALP<br>ALQNPPIRGGEGQNGGLPFPFPPDISRRVWNEEGEDGLPRPKDPVIPSIQ<br>LFPGLREPEEVQGSVDIALSVKCDNEKMIVAVEKDSFQASGYSGMDV<br>TLLDPTCKAKMNGTHFVLESPLNGCGTRPRWSALDGVVYYNSIVIQ |

TABLE 16-continued

Exemplary amino acid sequences of TGF-beta polypeptides or TGF-beta receptor polypeptides

| SEQ ID NO | Description | Amino acid sequence |
|---|---|---|
| | | VPALGDSSGWPDGYEDLESGDNGFPGDMDEGDASLFTRPEIVVFNCS LQQVRNPSSFQEQPHGNITFNMELYNTDLFLVPSQGVFSVPENGHVY VEVSVTKAEQELGFAIQTCFISPYSNPDRMSHYTIIENICPKDESVKFY SPKRVHFPIPQADMDKKRFSFVFKPVFNTSLLFLQCELTLCTKMEKHP QKLPKCVPPDEACTSLDASIIWAMMQNKKTFTKPLAVIHHEAESKEK GPSMKEPNPISPPIFHGLDTLTVMGIAFAAFVIGALLTGALWYIYSHT GETAGRQQVPTSPPASENSSAAHSIGSTQSTPCSSSSTA |
| SEQ ID NO: 126 | Human TGFBR3 isoform 2 (Q03167-2) | GPEPGALCELSPVSASHPVQALMESFTVLSGCASRGTTGLPQEVHVL NLRTAGQGPGQLQREVTLHLNPISSVHIFIHKSVVFLLNSPHPLVWHL KTERLATGVSRLFLVSEGSVVQFSSANFSLTAETEERNFPHGNEHLLN WARKEYGAVTSFTELKIARNIYIKVGEDQVFPPKCNIGKNFLSLNYLA EYLQPKAAEGCVMSSQPQNEEVHIIELITPNSNPYSAFQVDITIDIRPSQ EDLEVVKNLILILKCKKSVNWVIKSFDVKGSLKIIAPNSIGFGKESERS MTMTKSIRDDIPSTQGNLVKWALDNGYSPITSYTMAPVANRFHLRLE NNEEMGDEEVHTIPPELRILLDPGALPALQNPPIRGGEGQNGGLPFPFP DISRRVWNEEGEDGLPRPKDPVIPSIQLFPGLREPEEVQGSVDIALSVK CDNEKMIVAVEKDSFQASGYSGMDVTLLDPTCKAKMNGTHFVLESP LNGCGTRPRWSALDGVVYYNSIVIQVPALGDSSGWPDGYEDLESGD NGFPGDMDEGDASLFTRPEIVVFNCSLQQVRNPSSFQEQPHGNITFN MELYNTDLFLVPSQGVFSVPENGHVYVEVSVTKAEQELGFAIQTCFIS PYSNPDRMSHYTIIENICPKDESVKFYSPKRVHFPIPQADMDKKRFSF VFKPVFNTSLLFLQCELTLCTKMEKHPQKLPKCVPPDEACTSLDASII WAMMQNKKTFTKPLAVIHHEAESKEKGPSMKEPNPISPPIFHGLDTL TVMGIAFAAFVIGALLTGALWYIYSHTGETAGRQQVPTSPPASENSS AAHSIGSTQSTPCSSSSTA |
| SEQ ID NO: 108 | Human TGFBR3 fragment 1 | GPEPGALCELSPVSASHPVQALMESFTVLSGCASRGTTGLPQEVHVL NLRTAGQGPGQLQREVTLHLNPISSVHIFIHKSVVFLLNSPHPLVWHL KTERLATGVSRLFLVSEGSVVQFSSANFSLTAETEERNFPHGNEHLLN WARKEYGAVTSFTELKIARNIYIKVGEDQVFPPKCNIGKNFLSLNYLA EYLQPKAAEGCVMSSQPQNEEVHIIELITPNSNPYSAFQVDITIDIRPSQ EDLEVVKNLILILKCKKSVNWVIKSFDVKGSLKIIAPNSIGFGKESERS MTMTKSIRDDIPSTQGNLVKWALDNGYSPITSYTMAPVANRFHLRLE NNAEEMGDEEVHTIPPELRILLDPGALPALQNPPIRGGEGQNGGLPFP FPDISRRVWNEEGEDGLPRPKDPVIPSIQLFPGLREPEEVQGSVDIALS VKCDNEKMIVAVEKDSFQASGYSGMDVTLLDPTCKAKMNGTHFVL ESPLNGCGTRPRWSALDGVVYYNSIVIQVPALGDSSGWPDGYEDLES GDNGFPGDMDEGDASLFTRPEIVVFNCSLQQVRNPSSFQEQPHGNITF NMELYNTDLFLVPSQGVFSVPENGHVYVEVSVTKAEQELGFAIQTCF ISPYSNPDRMSHYTIIENICPKDESVKFYSPKRVHFPIPQADMDKKRFS FVFKPVFNTSLLFLQCELTLCTKMEKHPQKLPKCVPPDEACTSLDASII WAMMQNKKTFTKPLAVIHHEAESKEKGPSMKEPNPISPPIFHGLDTLTV |
| SEQ ID NO: 192 | hCH1- hFc_Hole- 3x4GS- TGFbR2 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVD KRVEPKSCDKTHTCPPCPAPELLGGPSVFLFPPKPKDTLMISRTPEVTC VVVDVSHEDPEVKFNWYVDGVEVHNAKTKPREEQYNSTYRVVSVL TVLHQDWLNGKEYKCKVSNKALPAPIEKTISKAKGQPREPQVCTLPP SREEMTKNQVSLSCAVKGFYPSDIAVEWESNGQPENNYKTTPPVLDS DGSFFLVSKLTVDKSRWQQGNVFSCSVMHEALHNHYTQKSLSLSPG XGGGGSGGGGSGGGGSIPPHVQKSVNNDMIVTDNNGAVKFPQLCKF CDVRFSTCDNQKSCMSNCSITSICEKPQEVCVAVWRKNDENITLETV CHDPKLPYHDFILEDAASPKCIMKEKKKPGETFFMCSCSSDECNDNII FSEEYNTSNPD, wherein X is K or absent |
| SEQ ID NO: 193 | hCH1- hFc_Knob- 3x4GS- TGFbR2 | ASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVD KRVEPKSCDKTHTCPPCPAPELLGGPSVFLFPPKPKDTLMISRTPEVTC VVVDVSHEDPEVKFNWYVDGVEVHNAKTKPREEQYNSTYRVVSVL TVLHQDWLNGKEYKCKVSNKALPAPIEKTISKAKGQPREPQVYTLPP CREEMTKNQVSLWCLVKGFYPSDIAVEWESNGQPENNYKTTPPVLD SDGSFFLYSKLTVDKSRWQQGNVFSCSVMHEALHNHYTQKSLSLSP GXGGGGSGGGGSGGGGSIPPHVQKSVNNDMIVTDNNGAVKFPQLCK FCDVRFSTCDNQKSCMSNCSITSICEKPQEVCVAVWRKNDENITLET VCHDPKLPYHDFILEDAASPKCIMKEKKKPGETFFMCSCSSDECNDNI IFSEEYNTSNPD, wherein X is K or absent |
| SEQ ID NO: 194 | hFc_Hole 3x4GS- TGFbR2 | DKTHTCPPCPAPELLGGPSVFLFPPKPKDTLMISRTPEVTCVVVDVSH EDPEVKFNWYVDGVEVHNAKTKPREEQYNSTYRVVSVLTVLHQDW LNGKEYKCKVSNKALPAPIEKTISKAKGQPREPQVCTLPPSREEMTK NQVSLSCAVKGFYPSDIAVEWESNGQPENNYKTTPPVLDSDGSFFLV SKLTVDKSRWQQGNVFSCSVMHEALHNHYTQKSLSLSPGXGGGGS GGGGSGGGGSIPPHVQKSVNNDMIVTDNNGAVKFPQLCKFCDVRFS |

TABLE 16-continued

Exemplary amino acid sequences of TGF-beta polypeptides or TGF-beta receptor polypeptides

| SEQ ID NO | Description | Amino acid sequence |
|---|---|---|
| | | TCDNQKSCMSNCSITSICEKPQEVCVAVWRKNDENITLETVCHDPKL PYHDFILEDAASPKCIMKEKKKPGETFFMCSCSSDECNDNIIFSEEYNT SNPD, wherein X is K or absent |
| SEQ ID NO: 195 | hFc_Knob-3x4GS-TGFbR2 | DKTHTCPPCPAPELLGGPSVFLFPPKPKDTLMISRTPEVTCVVVDVSH EDPEVKFNWYVDGVEVHNAKTKPREEQYNSTYRVVSVLTVLHQDW LNGKEYKCKVSNKALPAPIEKTISKAKGQPREPQVYTLPPCREEMTK NQVSLWCLVKGFYPSDIAVEWESNGQPENNYKTTPPVLDSDGSFFLY SKLTVDKSRWQQGNVFSCSVMHEALHNHYTQKSLSLSPGXGGGGS GGGGSGGGGSIPPHVQKSVNNDMIVTDNNGAVKFPQLCKFCDVRFS TCDNQKSCMSNCSITSICEKPQEVCVAVWRKNDENITLETVCHDPKL PYHDFILEDAASPKCIMKEKKKPGETFFMCSCSSDECNDNIIFSEEYNT SNPD, wherein X is K or absent |
| SEQ ID NO: 196 | TGFbR2-3x4GS-hCH1-hFc_Hole | IPPHVQKSVNNDMIVTDNNGAVKFPQLCKFCDVRFSTCDNQKSCMS NCSITSICEKPQEVCVAVWRKNDENITLETVCHDPKLPYHDFILEDAA SPKCIMKEKKKPGETFFMCSCSSDECNDNIIFSEEYNTSNPDGGGGSG GGGSGGGGSASTKGPSVFPLAPSSKSTSGGTAALGCLVKDYFPEPVT VSWNSGALTSGVHTFPAVLQSSGLYSLSSVVTVPSSSLGTQTYICNVN HKPSNTKVDKRVEPKSCDKTHTCPPCPAPELLGGPSVFLFPPKPKDTL MISRTPEVTCVVVDVSHEDPEVKFNWYVDGVEVHNAKTKPREEQY NSTYRVVSVLTVLHQDWLNGKEYKCKVSNKALPAPIEKTISKAKGQ PREPQVCTLPPSREEMTKNQVSLSCAVKGFYPSDIAVEWESNGQPEN NYKTTPPVLDSDGSFFLVSKLTVDKSRWQQGNVFSCSVMHEALHNH YTQKSLSLSPGX, wherein X is K or absent |
| SEQ ID NO: 197 | TGFbR2-3x4GS-hCH1-hFc_Knob | IPPHVQKSVNNDMIVTDNNGAVKFPQLCKFCDVRFSTCDNQKSCMS NCSITSICEKPQEVCVAVWRKNDENITLETVCHDPKLPYHDFILEDAA SPKCIMKEKKKPGETFFMCSCSSDECNDNIIFSEEYNTSNPDGGGGSG GGGSGGGGSASTKGPSVFPLAPSSKSTSGGTAALGCLVKDYFPEPVT VSWNSGALTSGVHTFPAVLQSSGLYSLSSVVTVPSSSLGTQTYICNVN HKPSNTKVDKRVEPKSCDKTHTCPPCPAPELLGGPSVFLFPPKPKDTL MISRTPEVTCVVVDVSHEDPEVKFNWYVDGVEVHNAKTKPREEQY NSTYRVVSVLTVLHQDWLNGKEYKCKVSNKALPAPIEKTISKAKGQ PREPQVYTLPPCREEMTKNQVSLWCLVKGFYPSDIAVEWESNGQPE NNYKTTPPVLDSDGSFFLYSKLTVDKSRWQQGNVFSCSVMHEALHN HYTQKSLSLSPGX, wherein X is K or absent |
| SEQ ID NO: 198 | TGFbR2-3x4GS-hCLIg_vl | IPPHVQKSVNNDMIVTDNNGAVKFPQLCKFCDVRFSTCDNQKSCMS NCSITSICEKPQEVCVAVWRKNDENITLETVCHDPKLPYHDFILEDAA SPKCIMKEKKKPGETFFMCSCSSDECNDNIIFSEEYNTSNPDGGGGSG GGGSGGGGSGQPKANPTVTLFPPSSEELQANKATLVCLISDFYPGAV TVAWKADGSPVKAGVETTKPSKQSNNKYAASSYLSLTPEQWKSHRS YSCQVTHEGSTVEKTVAPTECS |
| SEQ ID NO: 199 | TGFβR2-3x4GS-hCLIg_vk | IPPHVQKSVNNDMIVTDNNGAVKFPQLCKFCDVRFSTCDNQKSCMS NCSITSICEKPQEVCVAVWRKNDENITLETVCHDPKLPYHDFILEDAA SPKCIMKEKKKPGETFFMCSCSSDECNDNIIFSEEYNTSNPDGGGGSG GGGSGGGGSRTVAAPSVFIFPPSDEQLKSGTASVVCLLNNFYPREAK VQWKVDNALQSGNSQESVTEQDSKDSTYSLSSTLTLSKADYEKHKV YACEVTHQGLSSPVTKSFNRGEC |

Immune Cell Engagers

The immune cell engagers of the multispecific or multifunctional molecules disclosed herein can mediate binding to, and/or activation of, an immune cell, e.g., an immune effector cell. In some embodiments, the immune cell is chosen from a T cell, an NK cell, a B cell, a dendritic cell, or a macrophage cell engager, or a combination thereof. In some embodiments, the immune cell engager is chosen from one, two, three, or all of a T cell engager, NIK cell engager, a B cell engager, a dendritic cell engager, or a macrophage cell engager, or a combination thereof. The immune cell engager can be an agonist of the immune system. In some embodiments, the immune cell engager can be an antibody molecule, a ligand molecule (e.g., a ligand that further comprises an immunoglobulin constant region, e.g., an Fc region), a small molecule, a nucleotide molecule.

Natural Killer Cell Engagers

Natural Killer (NK) cells recognize and destroy tumors and virus-infected cells in an antibody-independent manner. The regulation of NK cells is mediated by activating and inhibiting receptors on the NK cell surface. One family of activating receptors is the natural cytotoxicity receptors (NCRs) which include NKp30, NKp44 and NKp46. The NCRs initiate tumor targeting by recognition of heparan sulfate on cancer cells. NKG2D is a receptor that provides both stimulatory and costimulatory innate immune responses on activated killer (NK) cells, leading to cytotoxic activity. DNAM1 is a receptor involved in intercellular adhesion, lymphocyte signaling, cytotoxicity and lymphokine secretion mediated by cytotoxic T-lymphocyte (CTL) and NK cell. DAP10 (also known as HCST) is a transmembrane adapter protein which associates with KLRK1 to form an activation receptor KLRK1-HCST in lymphoid and myeloid cells; this receptor plays a major role in triggering cytotoxicity against target cells expressing cell surface ligands such as MHC class I chain-related MICA and MICB, and U(optionally L1)6-binding proteins (ULBPs); it KLRK1-HCST receptor plays a role in immune surveillance against tumors and is required for cytolysis of tumors cells; indeed, melanoma cells that do not express KLRK1 ligands escape from immune surveillance mediated by NK cells. CD16 is a receptor for the Fc region of IgG, which binds complexed or aggregated IgG and also monomeric IgG and thereby mediates antibody-dependent cellular cytotoxicity (ADCC) and other antibody-dependent responses, such as phagocytosis.

The present disclosure provides, inter alia, multispecific (e.g., bi-, tri-, quad-specific) or multifunctional molecules, that are engineered to contain one or more NK cell engagers that mediate binding to and/or activation of an NK cell. Accordingly, in some embodiments, the NK cell engager is selected from an antigen binding domain or ligand that binds to (e.g., activates): NKp30, NKp40, NKp44, NKp46, NKG2D, DNAM1, DAP10, CD16 (e.g., CD16a, CD16b, or both), CRTAM, CD27, PSGL1, CD96, CD100 (SEMA4D), NKp80, CD244 (also known as SLAMF4 or 2B4), SLAMF6, SLAMF7, KIR2DS2, KIR2DS4, KIR3DS1, KIR2DS3, KIR2DS5, KIR2DS1, CD94, NKG2C, NKG2E, or CD160.

In some embodiments, the NK cell engager is an antigen binding domain that binds to NKp30 (e.g., NKp30 present, e.g., expressed or displayed, on the surface of an NK cell) and comprises any CDR amino acid sequence, framework region (FWR) amino acid sequence, or variable region amino acid sequence disclosed in Tables 7-10. In some embodiments, the NK cell engager is an antigen binding domain that binds to NKp30 (e.g., NKp30 present, e.g., expressed or displayed, on the surface of an NK cell) and comprises any CDR amino acid sequence, framework region (FWR) amino acid sequence, or variable region amino acid sequence disclosed in U.S. Pat. Nos. 6,979,546, 9,447,185, PCT Application No. WO2015121383A1, PCT Application No. WO2016110468A1, PCT Application No. WO2004056392A1, or U.S. Application Publication No. US20070231322A1, the sequences of which are hereby incorporated by reference. In some embodiments, binding of the NK cell engager, e.g., antigen binding domain that binds to NKp30, to the NK cell activates the NK cell. An antigen binding domain that binds to NKp30 (e.g., NKp30 present, e.g., expressed or displayed, on the surface of an NK cell) may be said to target NKp30, the NK cell, or both.

In some embodiments, the antigen binding domain that binds to NKp30 comprises one or more CDRs (e.g., VHCDR1, VHCDR2, VHCDR3, VLCDR1, VLCDR2, and/or VLCDR3 disclosed in Table 7, Table 18, or Table 8, or a sequence having at least 85%, 90%, 95%, or 99% identity thereto. In some embodiments, the antigen binding domain that binds to NKp30 comprises one or more framework regions (e.g., VHFWR1, VHFWR2, VHFWR3, VHFWR4, VLFWR1, VLFWR2, VLFWR3, and/or VLFWR4) disclosed in Table 7, Table 18, or Table 8, or a sequence having at least 85%, 90%, 95%, or 99% identity thereto. In some embodiments, the antigen binding domain that binds to NKp30 comprises a VH and/or a VL disclosed in Table 9, or a sequence having at least 85%, 90%, 95%, or 99% identity thereto. In some embodiments, the antigen binding domain that binds to NKp30 comprises an amino acid sequence disclosed in Table 10, or a sequence having at least 85%, 90%, 95%, or 99% identity thereto.

In some embodiments, the antigen binding domain that binds to NKp30 comprises a VH comprising a heavy chain complementarity determining region 1 (VHCDR1), a VHCDR2, and a VHCDR3, and a VL comprising a light chain complementarity determining region 1 (VLCDR1), a VLCDR2, and a VLCDR3.

In some embodiments, the VHCDR1, VHCDR2, and VHCDR3 comprise the amino acid sequences of SEQ ID NOs: 7313, 6001, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 7313, 6001, and 6002, respectively (or a sequence having at least 85%, 90%, 95%, or 99% identity thereto). In some embodiments, the VHCDR1, VHCDR2, and VHCDR3 comprise the amino acid sequences of SEQ ID NOs: 7313, 6008, and 6009, respectively (or a sequence having at least 85%, 90%, 95%, or 99% identity thereto). In some embodiments, the VHCDR1, VHCDR2, and VHCDR3 comprise the amino acid sequences of SEQ ID NOs: 7313, 7385, and 7315, respectively (or a sequence having at least 85%, 90%, 95%, or 99% identity thereto). In some embodiments, the VHCDR1, VHCDR2, and VHCDR3 comprise the amino acid sequences of SEQ ID NOs: 7313, 7318, and 6009, respectively (or a sequence having at least 85%, 90%, 95%, or 99% identity thereto).

In some embodiments, the VLCDR1, VLCDR2, and VLCDR3 comprise the amino acid sequences of SEQ ID NOs: 7326, 7327, and 7329, respectively (or a sequence having at least 85%, 90%, 95%, or 99% identity thereto). In some embodiments, the VLCDR1, VLCDR2, and VLCDR3 comprise the amino acid sequences of SEQ ID NOs: 6063, 6064, and 7293, respectively (or a sequence having at least 85%, 90%, 95%, or 99% identity thereto). In some embodiments, the VLCDR1, VLCDR2, and VLCDR3 comprise the amino acid sequences of SEQ ID NOs: 6070, 6071, and 6072, respectively (or a sequence having at least 85%, 90%, 95%, or 99% identity thereto). In some embodiments, the VLCDR1, VLCDR2, and VLCDR3 comprise the amino acid sequences of SEQ ID NOs: 6070, 6064, and 7321, respectively (or a sequence having at least 85%, 90%, 95%, or 99% identity thereto).

In some embodiments, the VHCDR1, VHCDR2, VHCDR3, VLCDR1, VLCDR2, and VLCDR3 comprise the amino acid sequences of SEQ ID NOs: 7313, 6001, 7315, 7326, 7327, and 7329, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7313, 6001, 6002, 6063, 6064, and 7293, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7313, 6008, 6009, 6070, 6071, and 6072, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7313, 7385, 7315, 6070, 6064, and 7321, respectively (or a sequence having at least 85%, 90%, 95%, or 99% identity thereto). In some embodiments, the VHCDR1, VHCDR2, VHCDR3, VLCDR1, VLCDR2, and VLCDR3 comprise the amino acid sequences of SEQ ID NOs: 7313, 7318, 6009, 6070, 6064, and 7321, respectively (or a sequence having at least 85%, 90%, 95%, or 99% identity thereto).

In some embodiments, the VH comprises an amino acid sequence selected from the group consisting of SEQ ID NOs: 7298 or 7300-7304 (or a sequence having at least 85%, 90%, 95%, or 99% identity thereto) and/or the VL comprises an amino acid sequence selected from the group consisting of SEQ ID NOs: 7299 or 7305-7309 (or a sequence having at least 85%, 90%, 95%, or 99% identity thereto). In some embodiments, the VH and VL comprise the amino acid sequences of SEQ ID NOs: 7302 and 7305, respectively (or a sequence having at least 85%, 90%, 95%, or 99% identity thereto). In some embodiments, the VH and VL comprise the amino acid sequences of SEQ ID NOs: 7302 and 7309, respectively (or a sequence having at least 85%, 90%, 95%, or 99% identity thereto).

In some embodiments, the VH comprises an amino acid sequence selected from the group consisting of SEQ ID NOs: 6121 or 6123-6128 (or a sequence having at least 85%, 90%, 95%, or 99% identity thereto) and/or the VL comprises an amino acid sequence selected from the group consisting of SEQ ID NOs: 7294 or 6137-6141 (or a sequence having at least 85%, 90%, 95%, or 99% identity thereto). In some embodiments, the VH comprises an amino acid sequence selected from the group consisting of SEQ ID NOs: 6122 or 6129-6134 (or a sequence having at least 85%, 90%, 95%, or 99% identity thereto) and/or the VL comprises an amino acid sequence selected from the group consisting of SEQ ID NOs: 6136 or 6142-6147 (or a sequence having at least 85%, 90%, 95%, or 99% identity thereto). In some embodiments, the VH and VL comprise the amino acid sequences of SEQ ID NOs: 7295 and 7296, respectively (or a sequence having at least 85%, 90%, 95%, or 99% identity thereto). In some embodiments, the VH and VL comprise the amino acid sequences of SEQ ID NOs: 7297 and 7296, respectively (or a sequence having at least 85%, 90%, 95%, or 99% identity thereto). In some embodiments, the VH and VL comprise the amino acid sequences of SEQ ID NOs: 6122 and 6136, respectively (or a sequence having at least 85%, 90%, 95%, or 99% identity thereto).

In some embodiments, the antigen binding domain that binds to NKp30 comprises the amino acid sequence of SEQ ID NO: 7310 (or a sequence having at least 85%, 90%, 95%, or 99% identity thereto). In some embodiments, the antigen binding domain that binds to NKp30 comprises the amino acid sequence of SEQ ID NO: 7311 (or a sequence having at least 85%, 90%, 95%, or 99% identity thereto). In some embodiments, the antigen binding domain that binds to NKp30 comprises the amino acid sequence of SEQ ID NO: 6187, 6188, 6189 or 6190 (or a sequence having at least 85%, 90%, 95%, or 99% identity thereto).

In some embodiments, the antigen binding domain that targets NKp30 comprises a VH comprising a heavy chain complementarity determining region 1 (VHCDR1) amino acid sequence of SEQ ID NO: 6000 (or a sequence with no more than 1, 2, 3, or 4 mutations, e.g., substitutions, additions, or deletions), a VHCDR2 amino acid sequence of SEQ ID NO: 6001 (or a sequence with no more than 1, 2, 3, or 4 mutations, e.g., substitutions, additions, or deletions), and/or a VHCDR3 amino acid sequence of SEQ ID NO: 6002 (or a sequence with no more than 1, 2, 3, or 4 mutations, e.g., substitutions, additions, or deletions). In some embodiments, the NKp30 antigen binding domain comprises a VH comprising a VHCDR1 amino acid sequence of SEQ ID NO: 6000, a VHCDR2 amino acid sequence of SEQ ID NO: 6001, and/or a VHCDR3 amino acid sequence of SEQ ID NO: 6002.

In some embodiments, the antigen binding domain that targets NKp30 comprises a VL comprising a light chain complementarity determining region 1 (VLCDR1) amino acid sequence of SEQ ID NO: 6063 (or a sequence with no more than 1, 2, 3, or 4 mutations, e.g., substitutions, additions, or deletions), a VLCDR2 amino acid sequence of SEQ ID NO: 6064 (or a sequence with no more than 1, 2, 3, or 4 mutations, e.g., substitutions, additions, or deletions), and/or a VLCDR3 amino acid sequence of SEQ ID NO: 7293 (or a sequence with no more than 1, 2, 3, or 4 mutations, e.g., substitutions, additions, or deletions). In some embodiments, the antigen binding domain that targets NKp30 comprises a VL comprising a VLCDR1 amino acid sequence of SEQ ID NO: 6063, a VLCDR2 amino acid sequence of SEQ ID NO: 6064, and a VLCDR3 amino acid sequence of SEQ ID NO: 7293.

In some embodiments, the antigen binding domain that targets NKp30 comprises a VH comprising a heavy chain complementarity determining region 1 (VHCDR1) amino acid sequence of SEQ ID NO: 6000 (or a sequence with no more than 1, 2, 3, or 4 mutations, e.g., substitutions, additions, or deletions), a VHCDR2 amino acid sequence of SEQ ID NO: 6001 (or a sequence with no more than 1, 2, 3, or 4 mutations, e.g., substitutions, additions, or deletions), and/or a VHCDR3 amino acid sequence of SEQ ID NO: 6002 (or a sequence with no more than 1, 2, 3, or 4 mutations, e.g., substitutions, additions, or deletions), and a VL comprising a light chain complementarity determining region 1 (VLCDR1) amino acid sequence of SEQ ID NO: 6063 (or a sequence with no more than 1, 2, 3, or 4 mutations, e.g., substitutions, additions, or deletions), a VLCDR2 amino acid sequence of SEQ ID NO: 6064 (or a sequence with no more than 1, 2, 3, or 4 mutations, e.g., substitutions, additions, or deletions), and/or a VLCDR3 amino acid sequence of SEQ ID NO: 7293 (or a sequence with no more than 1, 2, 3, or 4 mutations, e.g., substitutions, additions, or deletions). In some embodiments, the NKp30 antigen binding domain comprises a VH comprising a VHCDR1 amino acid sequence of SEQ ID NO: 6000, a VHCDR2 amino acid sequence of SEQ ID NO: 6001, and/or a VHCDR3 amino acid sequence of SEQ ID NO: 6002, and a VL comprising a VLCDR1 amino acid sequence of SEQ ID NO: 6063, a VLCDR2 amino acid sequence of SEQ ID NO: 6064, and a VLCDR3 amino acid sequence of SEQ ID NO: 7293.

In some embodiments, the antigen binding domain that targets NKp30 comprises a VH comprising a heavy chain complementarity determining region 1 (VHCDR1) amino acid sequence of SEQ ID NO: 6007 (or a sequence with no more than 1, 2, 3, or 4 mutations, e.g., substitutions, additions, or deletions), a VHCDR2 amino acid sequence of SEQ ID NO: 6008 (or a sequence with no more than 1, 2, 3, or 4 mutations, e.g., substitutions, additions, or deletions), and/or a VHCDR3 amino acid sequence of SEQ ID NO: 6009 (or a sequence with no more than 1, 2, 3, or 4 mutations, e.g., substitutions, additions, or deletions). In some embodiments, the NKp30 antigen binding domain comprises a VH comprising a VHCDR1 amino acid sequence of SEQ ID NO: 6007, a VHCDR2 amino acid sequence of SEQ ID NO: 6008, and/or a VHCDR3 amino acid sequence of SEQ ID NO: 6009.

In some embodiments, the antigen binding domain that targets NKp30 comprises a VL comprising a light chain complementarity determining region 1 (VLCDR1) amino acid sequence of SEQ ID NO: 6070 (or a sequence with no more than 1, 2, 3, or 4 mutations, e.g., substitutions, additions, or deletions), a VLCDR2 amino acid sequence of SEQ ID NO: 6071 (or a sequence with no more than 1, 2, 3, or 4 mutations, e.g., substitutions, additions, or deletions), and/or a VLCDR3 amino acid sequence of SEQ ID NO: 6072 (or a sequence with no more than 1, 2, 3, or 4 mutations, e.g., substitutions, additions, or deletions). In some embodiments, the antigen binding domain that targets NKp30 comprises a VL comprising a VLCDR1 amino acid sequence of SEQ ID NO: 6070, a VLCDR2 amino acid sequence of SEQ ID NO: 6071, and a VLCDR3 amino acid sequence of SEQ ID NO: 6072.

In some embodiments, the antigen binding domain that targets NKp30 comprises a VH comprising a heavy chain complementarity determining region 1 (VHCDR1) amino acid sequence of SEQ ID NO: 6007 (or a sequence with no more than 1, 2, 3, or 4 mutations, e.g., substitutions, additions, or deletions), a VHCDR2 amino acid sequence of SEQ ID NO: 6008 (or a sequence with no more than 1, 2, 3, or 4 mutations, e.g., substitutions, additions, or deletions), and/or a VHCDR3 amino acid sequence of SEQ ID NO: 6009 (or a sequence with no more than 1, 2, 3, or 4 mutations, e.g., substitutions, additions, or deletions), and a VL comprising a light chain complementarity determining region 1 (VLCDR1) amino acid sequence of SEQ ID NO: 6070 (or a sequence with no more than 1, 2, 3, or 4 mutations, e.g., substitutions, additions, or deletions), a VLCDR2 amino acid sequence of SEQ ID NO: 6071 (or a sequence with no more than 1, 2, 3, or 4 mutations, e.g., substitutions, additions, or deletions), and/or a VLCDR3 amino acid sequence of SEQ ID NO: 6072 (or a sequence with no more than 1, 2, 3, or 4 mutations, e.g., substitutions, additions, or deletions). In some embodiments, the NKp30 antigen binding domain comprises a VH comprising a VHCDR1 amino acid sequence of SEQ ID NO: 6007, a VHCDR2 amino acid sequence of SEQ ID NO: 6008, and/or a VHCDR3 amino acid sequence of SEQ ID NO: 6009, and a VL comprising a VLCDR1 amino acid sequence of SEQ ID NO: 6070, a VLCDR2 amino acid sequence of SEQ ID NO: 6071, and a VLCDR3 amino acid sequence of SEQ ID NO: 6072.

In some embodiments, the antigen binding domain that targets NKp30 comprises a VH comprising a heavy chain framework region 1 (VHFWR1) amino acid sequence of SEQ ID NO: 6003, a VHFWR2 amino acid sequence of SEQ ID NO: 6004, a VHFWR3 amino acid sequence of SEQ ID NO: 6005, and/or a VHFWR4 amino acid sequence of SEQ ID NO: 6006.

In some embodiments, the antigen binding domain that targets NKp30 comprises a VL comprising a light chain framework region 1 (VLFWR1) amino acid sequence of SEQ ID NO: 6066, a VLFWR2 amino acid sequence of SEQ ID NO: 6067, a VLFWR3 amino acid sequence of SEQ ID NO: 7292, and/or a VLFWR4 amino acid sequence of SEQ ID NO: 6069.

In some embodiments, the antigen binding domain that targets NKp30 comprises a VH comprising a heavy chain framework region 1 (VHFWR1) amino acid sequence of SEQ ID NO: 6003, a VHFWR2 amino acid sequence of SEQ ID NO: 6004, a VHFWR3 amino acid sequence of SEQ ID NO: 6005, and/or a VHFWR4 amino acid sequence of SEQ ID NO: 6006, and a VL comprising a light chain framework region 1 (VLFWR1) amino acid sequence of SEQ ID NO: 6066, a VLFWR2 amino acid sequence of SEQ ID NO: 6067, a VLFWR3 amino acid sequence of SEQ ID NO: 7292, and/or a VLFWR4 amino acid sequence of SEQ ID NO: 6069.

In some embodiments, the antigen binding domain that targets NKp30 comprises a VH comprising a VHFWR1 amino acid sequence of SEQ ID NO: 6003 (or a sequence with no more than 1, 2, 3, 4, 5, or 6 mutations, e.g., substitutions, additions, or deletions, therefrom), a VHFWR2 amino acid sequence of SEQ ID NO: 6004 (or a sequence with no more than 1, 2, 3, 4, 5, or 6 mutations, e.g., substitutions, additions, or deletions, therefrom), a VHFWR3 amino acid sequence of SEQ ID NO: 6005 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6006.

In some embodiments, the antigen binding domain that targets NKp30 comprises a VL comprising a VLFWR1 amino acid sequence of SEQ ID NO: 6066 (or a sequence with no more than 1, 2, or 3 mutations, e.g., substitutions, additions, or deletions), a VLFWR2 amino acid sequence of SEQ ID NO: 6067 (or a sequence with no more than 1 mutation, e.g., substitution, addition, or deletion), a VLFWR3 amino acid sequence of SEQ ID NO: 7292 (or a sequence with no more than 1 mutation, e.g., substitution, addition, or deletion), and/or a VLFWR4 amino acid sequence of SEQ ID NO: 6069.

In some embodiments, the antigen binding domain that targets NKp30 comprises a VH comprising a VHFWR1 amino acid sequence of SEQ ID NO: 6003 (or a sequence with no more than 1, 2, 3, 4, 5, or 6 mutations, e.g., substitutions, additions, or deletions, therefrom), a VHFWR2 amino acid sequence of SEQ ID NO: 6004 (or a sequence with no more than 1, 2, 3, 4, 5, or 6 mutations, e.g., substitutions, additions, or deletions, therefrom), a VHFWR3 amino acid sequence of SEQ ID NO: 6005 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6006, and a VL comprising a VLFWR1 amino acid sequence of SEQ ID NO: 6066 (or a sequence with no more than 1, 2, or 3 mutations, e.g., substitutions, additions, or deletions), a VLFWR2 amino acid sequence of SEQ ID NO: 6067 (or a sequence with no more than 1 mutation, e.g., substitution, addition, or deletion), a VLFWR3 amino acid sequence of SEQ ID NO: 7292 (or a sequence with no more than 1 mutation, e.g., substitution, addition, or deletion), and/or a VLFWR4 amino acid sequence of SEQ ID NO: 6069.

In some embodiments, the antigen binding domain that targets NKp30 comprises a VH comprising a heavy chain framework region 1 (VHFWR1) amino acid sequence of SEQ ID NO: 6010, a VHFWR2 amino acid sequence of SEQ ID NO: 6011, a VHFWR3 amino acid sequence of SEQ ID NO: 6012, and/or a VHFWR4 amino acid sequence of SEQ ID NO: 6013.

In some embodiments, the antigen binding domain that targets NKp30 comprises a VL comprising a light chain framework region 1 (VLFWR1) amino acid sequence of SEQ ID NO: 6073, a VLFWR2 amino acid sequence of SEQ ID NO: 6074, a VLFWR3 amino acid sequence of SEQ ID NO: 6075, and/or a VLFWR4 amino acid sequence of SEQ ID NO: 6076.

In some embodiments, the antigen binding domain that targets NKp30 comprises a VH comprising a heavy chain framework region 1 (VHFWR1) amino acid sequence of SEQ ID NO: 6010, a VHFWR2 amino acid sequence of SEQ ID NO: 6011, a VHFWR3 amino acid sequence of SEQ ID NO: 6012, and/or a VHFWR4 amino acid sequence of SEQ ID NO: 6013, and a VL comprising a light chain framework region 1 (VLFWR1) amino acid sequence of SEQ ID NO: 6073, a VLFWR2 amino acid sequence of SEQ ID NO: 6074, a VLFWR3 amino acid sequence of SEQ ID NO: 6075, and/or a VLFWR4 amino acid sequence of SEQ ID NO: 6076.

In some embodiments, the antigen binding domain that targets NKp30 comprises a VH comprising a VHFWR1 amino acid sequence of SEQ ID NO: 6010 (or a sequence with no more than 1, 2, 3, 4, 5, or 6 mutations, e.g., substitutions, additions, or deletions, therefrom), a VHFWR2 amino acid sequence of SEQ ID NO: 6011 (or a sequence with no more than 1, 2, 3, 4, 5, or 6 mutations, e.g., substitutions, additions, or deletions, therefrom), a VHFWR3 amino acid sequence of SEQ ID NO: 6012 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6013.

In some embodiments, the antigen binding domain that targets NKp30 comprises a VL comprising a VLFWR1 amino acid sequence of SEQ ID NO: 6073 (or a sequence with no more than 1, 2, or 3 mutations, e.g., substitutions, additions, or deletions), a VLFWR2 amino acid sequence of SEQ ID NO: 6074 (or a sequence with no more than 1 mutation, e.g., substitution, addition, or deletion), a VLFWR3 amino acid sequence of SEQ ID NO: 6075 (or a sequence with no more than 1 mutation, e.g., substitution, addition, or deletion), and/or a VLFWR4 amino acid sequence of SEQ ID NO: 6076.

In some embodiments, the antigen binding domain that targets NKp30 comprises a VH comprising a VHFWR1 amino acid sequence of SEQ ID NO: 6010 (or a sequence with no more than 1, 2, 3, 4, 5, or 6 mutations, e.g., substitutions, additions, or deletions, therefrom), a VHFWR2 amino acid sequence of SEQ ID NO: 6011 (or a sequence with no more than 1, 2, 3, 4, 5, or 6 mutations, e.g., substitutions, additions, or deletions, therefrom), a VHFWR3 amino acid sequence of SEQ ID NO: 6012 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6013, and a VL comprising a VLFWR1 amino acid sequence of SEQ ID NO: 6073 (or a sequence with no more than 1, 2, or 3 mutations, e.g., substitutions, additions, or deletions), a VLFWR2 amino acid sequence of SEQ ID NO: 6074 (or a sequence with no more than 1 mutation, e.g., substitution, addition, or deletion), a VLFWR3 amino acid sequence of SEQ ID NO: 6075 (or a sequence with no more than 1 mutation, e.g., substitution, addition, or deletion), and/or a VLFWR4 amino acid sequence of SEQ ID NO: 6076.

In some embodiments, the antigen binding domain that targets NKp30 comprises a VH comprising a heavy chain framework region 1 (VHFWR1) amino acid sequence of SEQ ID NO: 6014, a VHFWR2 amino acid sequence of SEQ ID NO: 6015, a VHFWR3 amino acid sequence of SEQ ID NO: 6016, and/or a VHFWR4 amino acid sequence of SEQ ID NO: 6017.

In some embodiments, the antigen binding domain that targets NKp30 comprises a VH comprising a VHFWR1 amino acid sequence of SEQ ID NO: 6014 (or a sequence with no more than 1, 2, 3, 4, 5, or 6 mutations, e.g., substitutions, additions, or deletions, therefrom), a VHFWR2 amino acid sequence of SEQ ID NO: 6015 (or a sequence with no more than 1, 2, 3, 4, 5, or 6 mutations, e.g., substitutions, additions, or deletions, therefrom), a VHFWR3 amino acid sequence of SEQ ID NO: 6016 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6017.

In some embodiments, the antigen binding domain that targets NKp30 comprises a VL comprising a light chain framework region 1 (VLFWR1) amino acid sequence of SEQ ID NO: 6077, a VLFWR2 amino acid sequence of SEQ ID NO: 6078, a VLFWR3 amino acid sequence of SEQ ID NO: 6079, and/or a VLFWR4 amino acid sequence of SEQ ID NO: 6080.

In some embodiments, the antigen binding domain that targets NKp30 comprises a VL comprising a VLFWR1 amino acid sequence of SEQ ID NO: 6077 (or a sequence with no more than 1, 2, or 3 mutations, e.g., substitutions, additions, or deletions), a VLFWR2 amino acid sequence of SEQ ID NO: 6078 (or a sequence with no more than 1 mutation, e.g., substitution, addition, or deletion), a VLFWR3 amino acid sequence of SEQ ID NO: 6079 (or a sequence with no more than 1 mutation, e.g., substitution, addition, or deletion), and/or a VLFWR4 amino acid sequence of SEQ ID NO: 6080.

In some embodiments, the antigen binding domain that targets NKp30 comprises a VH comprising a heavy chain framework region 1 (VHFWR1) amino acid sequence of SEQ ID NO: 6018, a VHFWR2 amino acid sequence of SEQ ID NO: 6019, a VHFWR3 amino acid sequence of SEQ ID NO: 6020, and/or a VHFWR4 amino acid sequence of SEQ ID NO: 6021.

In some embodiments, the antigen binding domain that targets NKp30 comprises a VH comprising a VHFWR1 amino acid sequence of SEQ ID NO: 6018 (or a sequence with no more than 1, 2, 3, 4, 5, or 6 mutations, e.g., substitutions, additions, or deletions, therefrom), a VHFWR2 amino acid sequence of SEQ ID NO: 6019 (or a sequence with no more than 1, 2, 3, 4, 5, or 6 mutations, e.g., substitutions, additions, or deletions, therefrom), a VHFWR3 amino acid sequence of SEQ ID NO: 6020 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6021.

In some embodiments, the antigen binding domain that targets NKp30 comprises a VL comprising a light chain framework region 1 (VLFWR1) amino acid sequence of SEQ ID NO: 6081, a VLFWR2 amino acid sequence of SEQ ID NO: 6082, a VLFWR3 amino acid sequence of SEQ ID NO: 6083, and/or a VLFWR4 amino acid sequence of SEQ ID NO: 6084.

In some embodiments, the antigen binding domain that targets NKp30 comprises a VL comprising a VLFWR1 amino acid sequence of SEQ ID NO: 6081 (or a sequence with no more than 1, 2, or 3 mutations, e.g., substitutions, additions, or deletions), a VLFWR2 amino acid sequence of SEQ ID NO: 6082 (or a sequence with no more than 1 mutation, e.g., substitution, addition, or deletion), a VLFWR3 amino acid sequence of SEQ ID NO: 6083 (or a sequence with no more than 1 mutation, e.g., substitution, addition, or deletion), and/or a VLFWR4 amino acid sequence of SEQ ID NO: 6084.

In some embodiments, the antigen binding domain that targets NKp30 comprises a VH comprising a heavy chain framework region 1 (VHFWR1) amino acid sequence of SEQ ID NO: 6022, a VHFWR2 amino acid sequence of SEQ ID NO: 6023, a VHFWR3 amino acid sequence of SEQ ID NO: 6024, and/or a VHFWR4 amino acid sequence of SEQ ID NO: 6025.

In some embodiments, the antigen binding domain that targets NKp30 comprises a VH comprising a VHFWR1 amino acid sequence of SEQ ID NO: 6022 (or a sequence with no more than 1, 2, 3, 4, 5, or 6 mutations, e.g., substitutions, additions, or deletions, therefrom), a VHFWR2 amino acid sequence of SEQ ID NO: 6023 (or a sequence with no more than 1, 2, 3, 4, 5, or 6 mutations, e.g., substitutions, additions, or deletions, therefrom), a VHFWR3 amino acid sequence of SEQ ID NO: 6024 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6025.

In some embodiments, the antigen binding domain that targets NKp30 comprises a VL comprising a light chain framework region 1 (VLFWR1) amino acid sequence of SEQ ID NO: 6085, a VLFWR2 amino acid sequence of SEQ ID NO: 6086, a VLFWR3 amino acid sequence of SEQ ID NO: 6087, and/or a VLFWR4 amino acid sequence of SEQ ID NO: 6088.

In some embodiments, the antigen binding domain that targets NKp30 comprises a VL comprising a VLFWR1 amino acid sequence of SEQ ID NO: 6085 (or a sequence with no more than 1, 2, or 3 mutations, e.g., substitutions, additions, or deletions), a VLFWR2 amino acid sequence of SEQ ID NO: 6086 (or a sequence with no more than 1 mutation, e.g., substitution, addition, or deletion), a VLFWR3 amino acid sequence of SEQ ID NO: 6087 (or a sequence with no more than 1 mutation, e.g., substitution, addition, or deletion), and/or a VLFWR4 amino acid sequence of SEQ ID NO: 6088.

In some embodiments, the antigen binding domain that targets NKp30 comprises a VH comprising a heavy chain framework region 1 (VHFWR1) amino acid sequence of SEQ ID NO: 6026, a VHFWR2 amino acid sequence of SEQ ID NO: 6027, a VHFWR3 amino acid sequence of SEQ ID NO: 6028, and/or a VHFWR4 amino acid sequence of SEQ ID NO: 6029.

In some embodiments, the antigen binding domain that targets NKp30 comprises a VH comprising a VHFWR1 amino acid sequence of SEQ ID NO: 6026 (or a sequence with no more than 1, 2, 3, 4, 5, or 6 mutations, e.g., substitutions, additions, or deletions, therefrom), a VHFWR2 amino acid sequence of SEQ ID NO: 6027 (or a sequence with no more than 1, 2, 3, 4, 5, or 6 mutations, e.g., substitutions, additions, or deletions, therefrom), a VHFWR3 amino acid sequence of SEQ ID NO: 6028 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6029.

In some embodiments, the antigen binding domain that targets NKp30 comprises a VL comprising a light chain framework region 1 (VLFWR1) amino acid sequence of SEQ ID NO: 6089, a VLFWR2 amino acid sequence of SEQ ID NO: 6090, a VLFWR3 amino acid sequence of SEQ ID NO: 6091, and/or a VLFWR4 amino acid sequence of SEQ ID NO: 6092.

In some embodiments, the antigen binding domain that targets NKp30 comprises a VL comprising a VLFWR1 amino acid sequence of SEQ ID NO: 6089 (or a sequence with no more than 1, 2, or 3 mutations, e.g., substitutions, additions, or deletions), a VLFWR2 amino acid sequence of SEQ ID NO: 6090 (or a sequence with no more than 1 mutation, e.g., substitution, addition, or deletion), a VLFWR3 amino acid sequence of SEQ ID NO: 6091 (or a sequence with no more than 1 mutation, e.g., substitution, addition, or deletion), and/or a VLFWR4 amino acid sequence of SEQ ID NO: 6092.

In some embodiments, the antigen binding domain that targets NKp30 comprises a VH comprising a heavy chain framework region 1 (VHFWR1) amino acid sequence of SEQ ID NO: 6030, a VHFWR2 amino acid sequence of SEQ ID NO: 6032, a VHFWR3 amino acid sequence of SEQ ID NO: 6033, and/or a VHFWR4 amino acid sequence of SEQ ID NO: 6034.

In some embodiments, the antigen binding domain that targets NKp30 comprises a VH comprising a VHFWR1 amino acid sequence of SEQ ID NO: 6030 (or a sequence with no more than 1, 2, 3, 4, 5, or 6 mutations, e.g., substitutions, additions, or deletions, therefrom), a VHFWR2 amino acid sequence of SEQ ID NO: 6032 (or a sequence with no more than 1, 2, 3, 4, 5, or 6 mutations, e.g., substitutions, additions, or deletions, therefrom), a VHFWR3 amino acid sequence of SEQ ID NO: 6033 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6034.

In some embodiments, the antigen binding domain that targets NKp30 comprises a VL comprising a light chain framework region 1 (VLFWR1) amino acid sequence of SEQ ID NO: 6093, a VLFWR2 amino acid sequence of SEQ ID NO: 6094, a VLFWR3 amino acid sequence of SEQ ID NO: 6095, and/or a VLFWR4 amino acid sequence of SEQ ID NO: 6096.

In some embodiments, the antigen binding domain that targets NKp30 comprises a VL comprising a VLFWR1 amino acid sequence of SEQ ID NO: 6093 (or a sequence with no more than 1, 2, or 3 mutations, e.g., substitutions, additions, or deletions), a VLFWR2 amino acid sequence of SEQ ID NO: 6094 (or a sequence with no more than 1 mutation, e.g., substitution, addition, or deletion), a VLFWR3 amino acid sequence of SEQ ID NO: 6095 (or a sequence with no more than 1 mutation, e.g., substitution, addition, or deletion), and/or a VLFWR4 amino acid sequence of SEQ ID NO: 6096.

In some embodiments, the antigen binding domain that targets NKp30 comprises a VH comprising a heavy chain framework region 1 (VHFWR1) amino acid sequence of SEQ ID NO: 6035, a VHFWR2 amino acid sequence of SEQ ID NO: 6036, a VHFWR3 amino acid sequence of SEQ ID NO: 6037, and/or a VHFWR4 amino acid sequence of SEQ ID NO: 6038.

In some embodiments, the antigen binding domain that targets NKp30 comprises a VH comprising a VHFWR1 amino acid sequence of SEQ ID NO: 6035 (or a sequence with no more than 1, 2, 3, 4, 5, or 6 mutations, e.g., substitutions, additions, or deletions, therefrom), a VHFWR2 amino acid sequence of SEQ ID NO: 6036 (or a sequence with no more than 1, 2, 3, 4, 5, or 6 mutations, e.g., substitutions, additions, or deletions, therefrom), a VHFWR3 amino acid sequence of SEQ ID NO: 6037 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6038.

In some embodiments, the antigen binding domain that targets NKp30 comprises a VH comprising a heavy chain framework region 1 (VHFWR1) amino acid sequence of SEQ ID NO: 6039, a VHFWR2 amino acid sequence of SEQ ID NO: 6040, a VHFWR3 amino acid sequence of SEQ ID NO: 6041, and/or a VHFWR4 amino acid sequence of SEQ ID NO: 6042.

In some embodiments, the antigen binding domain that targets NKp30 comprises a VH comprising a VHFWR1 amino acid sequence of SEQ ID NO: 6039 (or a sequence with no more than 1, 2, 3, 4, 5, or 6 mutations, e.g., substitutions, additions, or deletions, therefrom), a VHFWR2 amino acid sequence of SEQ ID NO: 6040 (or a sequence with no more than 1, 2, 3, 4, 5, or 6 mutations, e.g., substitutions, additions, or deletions, therefrom), a VHFWR3 amino acid sequence of SEQ ID NO: 6041 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6042.

In some embodiments, the antigen binding domain that targets NKp30 comprises a VL comprising a light chain framework region 1 (VLFWR1) amino acid sequence of SEQ ID NO: 6097, a VLFWR2 amino acid sequence of SEQ ID NO: 6098, a VLFWR3 amino acid sequence of SEQ ID NO: 6099, and/or a VLFWR4 amino acid sequence of SEQ ID NO: 6100.

In some embodiments, the antigen binding domain that targets NKp30 comprises a VL comprising a VLFWR1 amino acid sequence of SEQ ID NO: 6097 (or a sequence with no more than 1, 2, or 3 mutations, e.g., substitutions, additions, or deletions), a VLFWR2 amino acid sequence of SEQ ID NO: 6098 (or a sequence with no more than 1 mutation, e.g., substitution, addition, or deletion), a VLFWR3 amino acid sequence of SEQ ID NO: 6099 (or a sequence with no more than 1 mutation, e.g., substitution, addition, or deletion), and/or a VLFWR4 amino acid sequence of SEQ ID NO: 6100.

In some embodiments, the antigen binding domain that targets NKp30 comprises a VH comprising a heavy chain framework region 1 (VHFWR1) amino acid sequence of SEQ ID NO: 6043, a VHFWR2 amino acid sequence of SEQ ID NO: 6044, a VHFWR3 amino acid sequence of SEQ ID NO: 6045, and/or a VHFWR4 amino acid sequence of SEQ ID NO: 6046.

In some embodiments, the antigen binding domain that targets NKp30 comprises a VH comprising a VHFWR1 amino acid sequence of SEQ ID NO: 6043 (or a sequence with no more than 1, 2, 3, 4, 5, or 6 mutations, e.g., substitutions, additions, or deletions, therefrom), a VHFWR2 amino acid sequence of SEQ ID NO: 6044 (or a sequence with no more than 1, 2, 3, 4, 5, or 6 mutations, e.g., substitutions, additions, or deletions, therefrom), a VHFWR3 amino acid sequence of SEQ ID NO: 6045 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6046.

In some embodiments, the antigen binding domain that targets NKp30 comprises a VL comprising a light chain framework region 1 (VLFWR1) amino acid sequence of SEQ ID NO: 6101, a VLFWR2 amino acid sequence of SEQ ID NO: 6102, a VLFWR3 amino acid sequence of SEQ ID NO: 6103, and/or a VLFWR4 amino acid sequence of SEQ ID NO: 6104.

In some embodiments, the antigen binding domain that targets NKp30 comprises a VL comprising a VLFWR1 amino acid sequence of SEQ ID NO: 6101 (or a sequence with no more than 1, 2, or 3 mutations, e.g., substitutions, additions, or deletions), a VLFWR2 amino acid sequence of SEQ ID NO: 6102 (or a sequence with no more than 1 mutation, e.g., substitution, addition, or deletion), a VLFWR3 amino acid sequence of SEQ ID NO: 6103 (or a sequence with no more than 1 mutation, e.g., substitution, addition, or deletion), and/or a VLFWR4 amino acid sequence of SEQ ID NO: 6104.

In some embodiments, the antigen binding domain that targets NKp30 comprises a VH comprising a heavy chain framework region 1 (VHFWR1) amino acid sequence of SEQ ID NO: 6047, a VHFWR2 amino acid sequence of SEQ ID NO: 6048, a VHFWR3 amino acid sequence of SEQ ID NO: 6049, and/or a VHFWR4 amino acid sequence of SEQ ID NO: 6050.

In some embodiments, the antigen binding domain that targets NKp30 comprises a VH comprising a VHFWR1 amino acid sequence of SEQ ID NO: 6047 (or a sequence with no more than 1, 2, 3, 4, 5, or 6 mutations, e.g., substitutions, additions, or deletions, therefrom), a VHFWR2 amino acid sequence of SEQ ID NO: 6048 (or a sequence with no more than 1, 2, 3, 4, 5, or 6 mutations, e.g., substitutions, additions, or deletions, therefrom), a VHFWR3 amino acid sequence of SEQ ID NO: 6049 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6050.

In some embodiments, the antigen binding domain that targets NKp30 comprises a VL comprising a light chain framework region 1 (VLFWR1) amino acid sequence of SEQ ID NO: 6105, a VLFWR2 amino acid sequence of SEQ ID NO: 6106, a VLFWR3 amino acid sequence of SEQ ID NO: 6107, and/or a VLFWR4 amino acid sequence of SEQ ID NO: 6108.

In some embodiments, the antigen binding domain that targets NKp30 comprises a VL comprising a VLFWR1 amino acid sequence of SEQ ID NO: 6105 (or a sequence with no more than 1, 2, or 3 mutations, e.g., substitutions, additions, or deletions), a VLFWR2 amino acid sequence of SEQ ID NO: 6106 (or a sequence with no more than 1 mutation, e.g., substitution, addition, or deletion), a VLFWR3 amino acid sequence of SEQ ID NO: 6107 (or a sequence with no more than 1 mutation, e.g., substitution, addition, or deletion), and/or a VLFWR4 amino acid sequence of SEQ ID NO: 6108.

In some embodiments, the antigen binding domain that targets NKp30 comprises a VH comprising a heavy chain framework region 1 (VHFWR1) amino acid sequence of SEQ ID NO: 6051, a VHFWR2 amino acid sequence of SEQ ID NO: 6052, a VHFWR3 amino acid sequence of SEQ ID NO: 6053, and/or a VHFWR4 amino acid sequence of SEQ ID NO: 6054.

In some embodiments, the antigen binding domain that targets NKp30 comprises a VH comprising a VHFWR1 amino acid sequence of SEQ ID NO: 6051 (or a sequence with no more than 1, 2, 3, 4, 5, or 6 mutations, e.g., substitutions, additions, or deletions, therefrom), a VHFWR2 amino acid sequence of SEQ ID NO: 6052 (or a sequence with no more than 1, 2, 3, 4, 5, or 6 mutations, e.g., substitutions, additions, or deletions, therefrom), a VHFWR3 amino acid sequence of SEQ ID NO: 6053 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6054.

In some embodiments, the antigen binding domain that targets NKp30 comprises a VL comprising a light chain framework region 1 (VLFWR1) amino acid sequence of SEQ ID NO: 6109, a VLFWR2 amino acid sequence of SEQ ID NO: 6110, a VLFWR3 amino acid sequence of SEQ ID NO: 6111, and/or a VLFWR4 amino acid sequence of SEQ ID NO: 6112.

In some embodiments, the antigen binding domain that targets NKp30 comprises a VL comprising a VLFWR1 amino acid sequence of SEQ ID NO: 6109 (or a sequence with no more than 1, 2, or 3 mutations, e.g., substitutions, additions, or deletions), a VLFWR2 amino acid sequence of SEQ ID NO: 6110 (or a sequence with no more than 1 mutation, e.g., substitution, addition, or deletion), a VLFWR3 amino acid sequence of SEQ ID NO: 6111 (or a sequence with no more than 1 mutation, e.g., substitution, addition, or deletion), and/or a VLFWR4 amino acid sequence of SEQ ID NO: 6112.

In some embodiments, the antigen binding domain that targets NKp30 comprises a VH comprising a heavy chain framework region 1 (VHFWR1) amino acid sequence of SEQ ID NO: 6055, a VHFWR2 amino acid sequence of SEQ ID NO: 6056, a VHFWR3 amino acid sequence of SEQ ID NO: 6057, and/or a VHFWR4 amino acid sequence of SEQ ID NO: 6058.

In some embodiments, the antigen binding domain that targets NKp30 comprises a VH comprising a VHFWR1 amino acid sequence of SEQ ID NO: 6055 (or a sequence with no more than 1, 2, 3, 4, 5, or 6 mutations, e.g., substitutions, additions, or deletions, therefrom), a VHFWR2 amino acid sequence of SEQ ID NO: 6056 (or a sequence with no more than 1, 2, 3, 4, 5, or 6 mutations, e.g., substitutions, additions, or deletions, therefrom), a VHFWR3 amino acid sequence of SEQ ID NO: 6057 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6058.

In some embodiments, the antigen binding domain that targets NKp30 comprises a VL comprising a light chain framework region 1 (VLFWR1) amino acid sequence of SEQ ID NO: 6113, a VLFWR2 amino acid sequence of SEQ ID NO: 6114, a VLFWR3 amino acid sequence of SEQ ID NO: 6115, and/or a VLFWR4 amino acid sequence of SEQ ID NO: 6116.

In some embodiments, the antigen binding domain that targets NKp30 comprises a VL comprising a VLFWR1 amino acid sequence of SEQ ID NO: 6113 (or a sequence with no more than 1, 2, or 3 mutations, e.g., substitutions, additions, or deletions), a VLFWR2 amino acid sequence of SEQ ID NO: 6114 (or a sequence with no more than 1 mutation, e.g., substitution, addition, or deletion), a VLFWR3 amino acid sequence of SEQ ID NO: 6115 (or a sequence with no more than 1 mutation, e.g., substitution, addition, or deletion), and/or a VLFWR4 amino acid sequence of SEQ ID NO: 6116.

In some embodiments, the antigen binding domain that targets NKp30 comprises a VH comprising a heavy chain framework region 1 (VHFWR1) amino acid sequence of SEQ ID NO: 6059, a VHFWR2 amino acid sequence of SEQ ID NO: 6060, a VHFWR3 amino acid sequence of SEQ ID NO: 6061, and/or a VHFWR4 amino acid sequence of SEQ ID NO: 6062.

In some embodiments, the antigen binding domain that targets NKp30 comprises a VH comprising a VHFWR1 amino acid sequence of SEQ ID NO: 6059 (or a sequence with no more than 1, 2, 3, 4, 5, or 6 mutations, e.g., substitutions, additions, or deletions, therefrom), a VHFWR2 amino acid sequence of SEQ ID NO: 6060 (or a sequence with no more than 1, 2, 3, 4, 5, or 6 mutations, e.g., substitutions, additions, or deletions, therefrom), a VHFWR3 amino acid sequence of SEQ ID NO: 6061 (or a sequence with no more than 1, 2, 3, 4, 5, 6, 7, 8, 9, 10, or 11 mutations, e.g., substitutions, additions, or deletions), and/or a VHFWR4 amino acid sequence of SEQ ID NO: 6062.

In some embodiments, the antigen binding domain that targets NKp30 comprises a VL comprising a light chain framework region 1 (VLFWR1) amino acid sequence of SEQ ID NO: 6117, a VLFWR2 amino acid sequence of SEQ ID NO: 6118, a VLFWR3 amino acid sequence of SEQ ID NO: 6119, and/or a VLFWR4 amino acid sequence of SEQ ID NO: 6120.

In some embodiments, the antigen binding domain that targets NKp30 comprises a VL comprising a VLFWR1 amino acid sequence of SEQ ID NO: 6117 (or a sequence with no more than 1, 2, or 3 mutations, e.g., substitutions, additions, or deletions), a VLFWR2 amino acid sequence of SEQ ID NO: 6118 (or a sequence with no more than 1 mutation, e.g., substitution, addition, or deletion), a VLFWR3 amino acid sequence of SEQ ID NO: 6119 (or a sequence with no more than 1 mutation, e.g., substitution, addition, or deletion), and/or a VLFWR4 amino acid sequence of SEQ ID NO: 6120.

In some embodiments, the antigen binding domain that targets NKp30 comprises a VH comprising the amino acid sequence of SEQ ID NO: 6148 (or an amino acid sequence having at least about 77%, 80%, 85%, 90%, 95%, or 99% sequence identity to SEQ ID NO: 6148). In some embodiments, the antigen binding domain that targets NKp30 comprises a VH comprising the amino acid sequence of SEQ ID NO: 6149 (or an amino acid sequence having at least about 77%, 80%, 85%, 90%, 95%, or 99% sequence identity to SEQ ID NO: 6149). In some embodiments, the antigen binding domain that targets NKp30 comprises a VL comprising the amino acid sequence of SEQ ID NO: 6150 (or an amino acid sequence having at least about 93%, 95%, or 99% sequence identity to SEQ ID NO: 6150). In some embodiments, antigen binding domain that targets NKp30 comprises a VH comprising the amino acid sequence of SEQ ID NO: 6148. In some embodiments, antigen binding domain that targets NKp30 comprises a VH comprising the amino acid sequence of SEQ ID NO: 6149. In some embodiments, the antigen binding domain that targets NKp30 comprises a VL comprising the amino acid sequence of SEQ ID NO: 6150.

In some embodiments, the antigen binding domain that targets NKp30 comprises a VH comprising the amino acid sequence of SEQ ID NO: 6148, and a VL comprising the amino acid sequence of SEQ ID NO: 6150. In some embodiments, the antigen binding domain that targets NKp30 comprises a VH comprising the amino acid sequence of SEQ ID NO: 6149, and a VL comprising the amino acid sequence of SEQ ID NO: 6150.

In some embodiments, the antigen binding domain that targets NKp30 comprises a VH comprising the amino acid sequence of SEQ ID NO: 6151 (or an amino acid sequence having at least about 77%, 80%, 85%, 90%, 95%, or 99% sequence identity to SEQ ID NO: 6151). In some embodiments, the antigen binding domain that targets NKp30 comprises a VH comprising the amino acid sequence of SEQ ID NO: 6152 (or an amino acid sequence having at least about 77%, 80%, 85%, 90%, 95%, or 99% sequence identity to SEQ ID NO: 6152). In some embodiments, the antigen binding domain that targets NKp30 comprises a VL comprising the amino acid sequence of SEQ ID NO: 6153 (or an amino acid sequence having at least about 93%, 95%, or 99% sequence identity to SEQ ID NO: 6153). In some embodiments, antigen binding domain that targets NKp30 comprises a VH comprising the amino acid sequence of SEQ ID NO: 6151. In some embodiments, antigen binding domain that targets NKp30 comprises a VH comprising the amino acid sequence of SEQ ID NO: 6152. In some embodiments, the antigen binding domain that targets NKp30 comprises a VL comprising the amino acid sequence of SEQ ID NO: 6153.

In some embodiments, the antigen binding domain that targets NKp30 comprises a VH comprising the amino acid sequence of SEQ ID NO: 6151, and a VL comprising the amino acid sequence of SEQ ID NO: 6153. In some embodiments, the antigen binding domain that targets NKp30 comprises a VH comprising the amino acid sequence of SEQ ID NO: 6152, and a VL comprising the amino acid sequence of SEQ ID NO: 6153.

In some embodiments, the antigen binding domain that targets NKp30 comprises an scFv. In some embodiments, the scFv comprises an amino acid sequence selected from SEQ ID NOs: 6187-6190, or an amino acid sequence having at least about 93%, 95%, or 99% sequence identity thereto.

TABLE 7

Exemplary heavy chain CDRs and FWRs of NKp30-targeting antigen binding domains

| Ab ID | VHFWR1 | VHCDR1 | VHFWR2 | VHCDR2 | VHFWR3 | VHCDR3 | VHFWR4 |
|---|---|---|---|---|---|---|---|
| 9G1-HC | QIQLQESGPGLVKPSQSLSLTCSVTGFSIN (SEQ ID NO: 6003) | TGGYHWN (SEQ ID NO: 6000) | WIRQFPGKKLEWMG (SEQ ID NO: 6004) | YIYSSGSTSYNPSLKS (SEQ ID NO: 6001) | RISITRDTSKNQFFLQLNSVTTEDTATYYCAR (SEQ ID NO: 6005) | GNWHYFDF (SEQ ID NO: 6002) | WGQGTMVTVSS (SEQ ID NO: 6006) |
| 15H6-HC | QIQLQESGPGLVKPSQSLSLTCSVTGFSIN (SEQ ID NO: 6010) | TGGYHWN (SEQ ID NO: 6007) | WIRQFPGKKLEWMG (SEQ ID NO: 6011) | YIYSSGTTRYNPSLKS (SEQ ID NO: 6008) | RISITRDTSKNQFFLQLNSVTPEDTATYYCTR (SEQ ID NO: 6012) | GNWHYFDY (SEQ ID NO: 6009) | WGQGTLVAVSS (SEQ ID NO: 6013) |
| 9G1-HC_1 | QIQLQESGPGLVKPSETLSLTCTVSGFSIN (SEQ ID NO: 6014) | TGGYHWN (SEQ ID NO: 6000) | WIRQPAGKGLEWIG (SEQ ID NO: 6015) | YIYSSGSTSYNPSLKS (SEQ ID NO: 6001) | RVTMSRDTSKNQFSLKLSSVTAADTAVYYCAR (SEQ ID NO: 6016) | GNWHYFDF (SEQ ID NO: 6002) | WGQGTMVTVSS (SEQ ID NO: 6017) |
| 9G1-HC_2 | QIQLQESGPGLVKPSQTLSLTCTVSGFSIN (SEQ ID NO: 6018) | TGGYHWN (SEQ ID NO: 6000) | WIRQHPGKGLEWIG (SEQ ID NO: 6019) | YIYSSGSTSYNPSLKS (SEQ ID NO: 6001) | LVTISRDTSKNQFSLKLSSVTAADTAVYYCAR (SEQ ID NO: 6020) | GNWHYFDF (SEQ ID NO: 6002) | WGQGTMVTVSS (SEQ ID NO: 6021) |
| 9G1-HC_3 | EIQLLESGGGLVQPGGSLRLSCAVSGFSIN (SEQ ID NO: 6022) | TGGYHWN (SEQ ID NO: 6000) | WVRQAPGKGLEWVG (SEQ ID NO: 6023) | YIYSSGSTSYNPSLKS (SEQ ID NO: 6001) | RFTISRDTSKNTFYLQMNSLRAEDTAVYYCAR (SEQ ID NO: 6024) | GNWHYFDF (SEQ ID NO: 6002) | WGQGTMVTVSS (SEQ ID NO: 6025) |
| 9G1-HC_4 | QIQLVQSGAEVKKPGSSVKVSCKVSGFSIN (SEQ ID NO: 6026) | TGGYHWN (SEQ ID NO: 6000) | WVRQAPGQGLEWMG (SEQ ID NO: 6027) | YIYSSGSTSYNPSLKS (SEQ ID NO: 6001) | RVTITRDTSTNTFYMELSSLRSEDTAVYYCAR (SEQ ID NO: 6028) | GNWHYFDF (SEQ ID NO: 6002) | WGQGTMVTVSS (SEQ ID NO: 6029) |
| 9G1-HC_5 | EIQLVESGGGLVQPGGSLRLSCAVSGFSIN (SEQ ID NO: 6030) | TGGYHWN (SEQ ID NO: 6000) | WVRQAPGKGLEWVG (SEQ ID NOL 6032) | YIYSSGSTSYNPSLKS (SEQ ID NO: 6001) | RFTISRDTAKNSFYLQMNSLRAEDTAVYYCAR (SEQ ID NO: 6033) | GNWHYFDF (SEQ ID NO: 6002) | WGQGTMVTVSS (SEQ ID NO: 6034) |
| 9G1-HC_6 | QIQLVQSGAEVKKPGASVKVSCKVSGFSIN (SEQ ID NO: 6035) | TGGYHWN (SEQ ID NO: 6000) | WVRQAPGQGLEWMG (SEQ ID NO: 6036) | YIYSSGSTSYNPSLKS (SEQ ID NO: 6001) | RVTMTRDTSTNTFYMELSSLRSEDTAVYYCAR (SEQ ID NO: 6037) | GNWHYFDF (SEQ ID NO: 6002) | WGQGTMVTVSS (SEQ ID NO: 6038) |
| 15H6-HC_1 | QIQLQESGPGLVKPSQTLSLTCTVSGFSIN (SEQ ID NO: 6039) | TGGYHWN (SEQ ID NO: 6007) | WIRQHPGKGLEWIG (SEQ ID NO: 6040) | YIYSSGTTRYNPSLKS (SEQ ID NO: 6008) | LVTISRDTSKNQFSLKLSSVTAADTAVYYCAR (SEQ ID NO: 6041) | GNWHYFDY (SEQ ID NO: 6009) | WGQGTLVTVSS (SEQ ID NO: 6042) |
| 15H6-HC_2 | QIQLQESGPGLVKPSETLSLTCTVSGFSIN (SEQ ID | TGGYHWN (SEQ ID NO: | WIRQPAGKGLEWIG (SEQ ID NO: | YIYSSGTTRYNPSLKS (SEQ ID NO: | RVTMSRDTSKNQFSLKLSSVTAADTAVYYCAR (SEQ | GNWHYFDY (SEQ ID NO: | WGQGTLVTVSS (SEQ ID NO: |

TABLE 7-continued

Exemplary heavy chain CDRs and FWRs of NKp30-targeting antigen binding domains

| Ab ID | VHFWR1 | VHCDR1 | VHFWR2 | VHCDR2 | VHFWR3 | VHCDR3 | VHFWR4 |
|---|---|---|---|---|---|---|---|
| | ID NO: 6043) | 6007) | 6044) | 6008) | ID NO: 6045) | 6009) | 6046) |
| 15H6-HC_3 | EIQLLESGGGLVQPGGSLRLSCAVSGFSIN (SEQ ID NO: 6047) | TGGYHWN (SEQ ID NO: 6007) | WVRQAPGKGLEWVG (SEQ ID NO: 6048) | YIYSSGTTRYNPSLKS (SEQ ID NO: 6008) | RFTISRDTSKNTFYLQMNSLRAEDTAVYYCAR (SEQ ID NO: 6049) | GNWHYFDY (SEQ ID NO: 6009) | WGQGTLVTVSS (SEQ ID NO: 6050) |
| 15H6-HC_4 | QIQLVESGGGLVKPGGSLRLSCAVSGFSIN (SEQ ID NO: 6051) | TGGYHWN (SEQ ID NO: 6007) | WIRQAPGKGLEWVG (SEQ ID NO: 6052) | YIYSSGTTRYNPSLKS (SEQ ID NO: 6008) | RFTISRDTAKNSFYLQMNSLRAEDTAVYYCAR (SEQ ID NO: 6053) | GNWHYFDY (SEQ ID NO: 6009) | WGQGTLVTVSS (SEQ ID NO: 6054) |
| 15H6-HC_5 | QIQLVQSGAEVKKPGASVKVSCKVSGFSIN (SEQ ID NO: 6055) | TGGYHWN (SEQ ID NO: 6007) | WVRQAPGQGLEWMG (SEQ ID NO: 6056) | YIYSSGTTRYNPSLKS (SEQ ID NO: 6008) | RVTMTRDTSTNTFYMELSSLRSEDTAVYYCAR (SEQ ID NO: 6057) | GNWHYFDY (SEQ ID NO: 6009) | WGQGTLVTVSS (SEQ ID NO: 6058) |
| 15H6-HC_6 | EIQLVQSGAEVKKPGATVKISCKVSGFSIN (SEQ ID NO: 6059) | TGGYHWN (SEQ ID NO: 6007) | WVQQAPGKGLEWMG (SEQ ID NO: 6060) | YIYSSGTTRYNPSLKS (SEQ ID NO: 6008) | RVTITRDTSTNTFYMELSSLRSEDTAVYCAR (SEQ ID NO: 6061) | GNWHYFDY (SEQ ID NO: 6009) | WGQGTLVTVSS (SEQ ID NO: 6062) |

TABLE 18

Exemplary heavy chain CDRs and FWRs of NKp30-targeting antigen binding domains (according to the Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| 9G1-HC | QIQLQESGPGLVKPSQSLSLTCSVTGFSINTG (SEQ ID NO: 7317) | GYHWN (SEQ ID NO: 7313) | WIRQFPGKKLEWMG (SEQ ID NO: 6004) | YIYSSGSTSYNPSLKS (SEQ ID NO: 6001) | RISITRDTSKNQFFLQLNSVTTEDTATYYCAR (SEQ ID NO: 6005) | GNWHYFDF (SEQ ID NO: 6002) | WGQGTMVTVS (SEQ ID NO: 6006) |
| 15H6-HC | QIQLQESGPGLVKPSQSLSLTCSVTGFSINTG (SEQ ID NO: 7317) | GYHWN (SEQ ID NO: 7313) | WIRQFPGKKLEWMG (SEQ ID NO: 6011) | YIYSSGTTRYNPSLKS (SEQ ID NO: 6008) | RISITRDTSKNQFFLQLNSVTPEDTATYYCTR (SEQ ID NO: 6012) | GNWHYFDY (SEQ ID NO: 6009) | WGQGTLVAVSS (SEQ ID NO: 6013) |
| 9G1-HC_1 | QIQLQESGPGLVKPSETLSLTCTVSGFSINTG (SEQ ID NO: 7371) | GYHWN (SEQ ID NO: 7313) | WIRQPAGKGLEWIG (SEQ ID NO: 6015) | YIYSSGSTSYNPSLKS (SEQ ID NO: 6001) | RVTMSRDTSKNQFSLKLSSVTAADTAVYYCAR (SEQ ID NO: 6016) | GNWHYFDF (SEQ ID NO: 6002) | WGQGTMVTVS (SEQ ID NO: 6017) |
| 9G1-HC_2 | QIQLQESGPGLVKPSQTLSLTCTVSGFSINTG (SEQ ID NO: 7372) | GYHWN (SEQ ID NO: 7313) | WIRQHPGKGLEWIG (SEQ ID NO: 6019) | YIYSSGSTSYNPSLKS (SEQ ID NO: 6001) | LVTISRDTSKNQFSLKLSSVTAADTAVYYCAR (SEQ ID NO: 6020) | GNWHYFDF (SEQ ID NO: 6002) | WGQGTMVTVS (SEQ ID NO: 6021) |
| 9G1-HC_3 | EIQLLESGGGLVQPGGSLRLSCAVSGFSINTG (SEQ ID NO: 7373) | GYHWN (SEQ ID NO: 7313) | WVRQAPGKGLEWVG (SEQ ID NO: 6023) | YIYSSGSTSYNPSLKS (SEQ ID NO: 6001) | RFTISRDTSKNTFYLQMNSLRAEDTAVYYCAR (SEQ ID NO: 6024) | GNWHYFDF (SEQ ID NO: 6002) | WGQGTMVTVS (SEQ ID NO: 6025) |

TABLE 18-continued

Exemplary heavy chain CDRs and FWRs of NKp30-targeting antigen binding domains (according to the Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| 9G1-HC_4 | QIQLVQSGAEVKKPGSSVKVSCKVSGFSINTG (SEQ ID NO: 7374) | GYHWN (SEQ ID NO: 7313) | WVRQAPGQGLEWMG (SEQ ID NO: 6027) | YIYSSGSTSYNPSLKS (SEQ ID NO: 6001) | RVTITRDTSTNTFYMELSSLRSEDTAVYYCAR (SEQ ID NO: 6028) | GNWHYFDF (SEQ ID NO: 6002) | WGQGTMVTVSS (SEQ ID NO: 6029) |
| 9G1-HC_5 | EIQLVESGGGLVQPGGSLRLSCAVSGFSINTG (SEQ ID NO: 7375) | GYHWN (SEQ ID NO: 7313) | WVRQAPGKGLEWVG (SEQ ID NOL 6032) | YIYSSGSTSYNPSLKS (SEQ ID NO: 6001) | RFTISRDTAKNSFYLQMNSLRAEDTAVYYCAR (SEQ ID NO: 6033) | GNWHYFDF (SEQ ID NO: 6002) | WGQGTMVTVSS (SEQ ID NO: 6034) |
| 9G1-HC_6 | QIQLVQSGAEVKKPGASVKVSCKVSGFSINTG (SEQ ID NO: 7376) | GYHWN (SEQ ID NO: 7313) | WVRQAPGQGLEWMG (SEQ ID NO: 6036) | YIYSSGSTSYNPSLKS (SEQ ID NO: 6001) | RVTMTRDTSTNTFYMELSSLRSEDTAVYYCAR (SEQ ID NO: 6037) | GNWHYFDF (SEQ ID NO: 6002) | WGQGTMVTVSS (SEQ ID NO: 6038) |
| 15H6-HC_1 | QIQLQESGPGLVKPSQTLSLTCTVSGFSINTG (SEQ ID NO: 7372) | GYHWN (SEQ ID NO: 7313) | WIRQHPGKGLEWIG (SEQ ID NO: 6040) | YIYSSGTTRYNPSLKS (SEQ ID NO: 6008) | LVTISRDTSKNQFSLKLSSVTAADTAVYYCAR (SEQ ID NO: 6041) | GNWHYFDY (SEQ ID NO: 6009) | WGQGTLVTVSS (SEQ ID NO: 6042) |
| 15H6-HC_2 | QIQLQESGPGLVKPSETLSLTCTVSGFSINTG (SEQ ID NO: 7371) | GYHWN (SEQ ID NO: 7313) | WIRQPAGKGLEWIG (SEQ ID NO: 6044) | YIYSSGTTRYNPSLKS (SEQ ID NO: 6008) | RVTMSRDTSKNQFSLKLSSVTAADTAVYYCAR (SEQ ID NO: 6045) | GNWHYFDY (SEQ ID NO: 6009) | WGQGTLVTVSS (SEQ ID NO: 6046) |
| 15H6-HC_3 | EIQLLESGGGLVQPGGSLRLSCAVSGFSINTG (SEQ ID NO: 7373) | GYHWN (SEQ ID NO: 7313) | WVRQAPGKGLEWVG (SEQ ID NO: 6048) | YIYSSGTTRYNPSLKS (SEQ ID NO: 6008) | RFTISRDTSKNTFYLQMNSLRAEDTAVYYCAR (SEQ ID NO: 6049) | GNWHYFDY (SEQ ID NO: 6009) | WGQGTLVTVSS (SEQ ID NO: 6050) |
| 15H6-HC_4 | QIQLVESGGGLVKPGGSLRLSCAVSGFSINTG (SEQ ID NO: 7377) | GYHWN (SEQ ID NO: 7313) | WIRQAPGKGLEWVG (SEQ ID NO: 6052) | YIYSSGTTRYNPSLKS (SEQ ID NO: 6008) | RFTISRDTAKNSFYLQMNSLRAEDTAVYYCAR (SEQ ID NO: 6053) | GNWHYFDY (SEQ ID NO: 6009) | WGQGTLVTVSS (SEQ ID NO: 6054) |
| 15H6-HC_5 | QIQLVQSGAEVKKPGASVKVSCKVSGFSINTG (SEQ ID NO: 7376) | GYHWN (SEQ ID NO: 7313) | WVRQAPGQGLEWMG (SEQ ID NO: 6056) | YIYSSGTTRYNPSLKS (SEQ ID NO: 6008) | RVTMTRDTSTNTFYMELSSLRSEDTAVYYCAR (SEQ ID NO: 6057) | GNWHYFDY (SEQ ID NO: 6009) | WGQGTLVTVSS (SEQ ID NO: 6058) |
| 15H6-HC_6 | EIQLVQSGAEVKKPGATVKISCKVSGFSINTG (SEQ ID NO: 7378) | GYHWN (SEQ ID NO: 7313) | WVQQAPGKGLEWMG (SEQ ID NO: 6060) | YIYSSGTTRYNPSLKS (SEQ ID NO: 6008) | RVTITRDTSTNTFYMELSSLRSEDTAVYYCAR (SEQ ID NO: 6061) | GNWHYFDY (SEQ ID NO: 6009) | WGQGTLVTVSS (SEQ ID NO: 6062) |
| 9D9-HC | QIQLQESGPGLVKPSQSLSLSCSVTGFSINTG (SEQ ID NO: 7312) | GYHWN (SEQ ID NO: 7313) | WIRQFPGKKVEWMG (SEQ ID NO: 7314) | YIYSSGTTKYNPSLKS (SEQ ID NO: 7385) | RISITRDTSKNQFFLQLNSVTTEDTATYYCAR (SEQ ID NO: 6005) | GDWHYFDY (SEQ ID NO: 7315) | WGQGTMVAVSS (SEQ ID NO: 7316) |
| 3A12-HC | QIQLQESGPGLVKPSQSLSLTCSVTGFSINTG | GYHWN (SEQ ID NO: 7313) | WIRQFPGKKLEWMG (SEQ ID NO: 6004) | YIYSSGTTRYNPSLKS (SEQ ID NO: | RFSITRDTSKNQFFLQLNSVTTEDTATYYCTR | GNWHYFDY (SEQ ID NO: | WGQGTLVAVSS (SEQ ID NO: |

TABLE 18-continued

Exemplary heavy chain CDRs and FWRs of NKp30-targeting antigen binding domains (according to the Kabat numbering scheme)

| Ab ID | VHFWR1 | VHCDR1 | VHFWR2 | VHCDR2 | VHFWR3 | VHCDR3 | VHFWR4 |
|---|---|---|---|---|---|---|---|
| | (SEQ ID NO: 7317) | | | 7318) | (SEQ ID NO: 7319) | 6009) | 6013) |
| 12D10-HC | QIQLQESGPGLVKPSQSLSLTCSVTGFSINTG (SEQ ID NO: 7317) | GYHWN (SEQ ID NO: 7313) | WIRQFPGKKLEWMG (SEQ ID NO: 6004) | YIYSSGTTRYNPSLKS (SEQ ID NO: 6008) | RISITRDTSKNQFFLQLNSVTPEDTATYYCTR (SEQ ID NO: 6012) | GNWHYFDY (SEQ ID NO: 6009) | WGQGTLVAVSS (SEQ ID NO: 6013) |
| 15E1-HC | QIQLQESGPGLVKPSQSLSLSCSVTGFSITTT (SEQ ID NO: 7322) | GYHWN (SEQ ID NO: 7313) | WIRQFPGKKLEWMG (SEQ ID NO: 6004) | YIYSSGSTSYNPSLKS (SEQ ID NO: 6001) | RFSITRDTSKNQFFLQLNSVTTEDTATYYCAR (SEQ ID NO: 7323) | GDWHYFDY (SEQ ID NO: 7315) | WGPGTMVTVSS (SEQ ID NO: 7324) |
| 15E1-humanized variant_VH1 | QIQLQESGPGLVKPSQTLSLTCTVSGFSITTT (SEQ ID NO: 7330) | GYHWN (SEQ ID NO: 7313) | WIRQHPGKGLEWIG (SEQ ID NO: 6019) | YIYSSGSTSYNPSLKS (SEQ ID NO: 6001) | LVTISRDTSKNQFSLKLSSVTAADTAVYYCAR (SEQ ID NO: 6020) | GDWHYFDY (SEQ ID NO: 7315) | WGQGTMVTVSS (SEQ ID NO: 6006) |
| 15E1-humanized variant_VH2 | QIQLVESGGGLVKPGGSLRLSCAVSGFSITTT (SEQ ID NO: 7331) | GYHWN (SEQ ID NO: 7313) | WIRQAPGKGLEWVG (SEQ ID NO: 6052) | YIYSSGSTSYNPSLKS (SEQ ID NO: 6001) | RFTISRDTAKNSFYLQMNSLRAEDTAVYYCAR (SEQ ID NO: 6033) | GDWHYFDY (SEQ ID NO: 7315) | WGQGTMVTVSS (SEQ ID NO: 6006) |
| 15E1-humanized variant_VH3 | EIQLLESGGGLVQPGGSLRLSCAVSGFSITTT (SEQ ID NO: 7332) | GYHWN (SEQ ID NO: 7313) | WVRQAPGKGLEWVG (SEQ ID NO: 6023) | YIYSSGSTSYNPSLKS (SEQ ID NO: 6001) | RFTISRDTSKNTFYLQMNSLRAEDTAVYYCAR (SEQ ID NO: 6024) | GDWHYFDY (SEQ ID NO: 7315) | WGQGTMVTVSS (SEQ ID NO: 6006) |
| 15E1-humanized variant_VH4 | EIQLVESGGGLVQPGGSLRLSCAVSGFSITTT (SEQ ID NO: 7333) | GYHWN (SEQ ID NO: 7313) | WVRQAPGKGLEWVG (SEQ ID NO: 6023) | YIYSSGSTSYNPSLKS (SEQ ID NO: 6001) | RFTISRDTAKNSFYLQMNSLRAEDTAVYYCAR (SEQ ID NO: 6033) | GDWHYFDY (SEQ ID NO: 7315) | WGQGTMVTVSS (SEQ ID NO: 6006) |
| 15E1-humanized variant_VH5 | QIQLVQSGAEVKKPGASVKVSCKVSGFSITTT (SEQ ID NO: 7334) | GYHWN (SEQ ID NO: 7313) | WVRQAPGQGLEWMG (SEQ ID NO: 6027) | YIYSSGSTSYNPSLKS (SEQ ID NO: 6001) | RVTMTRDTSTNTFYMELSSLRSEDTAVYYCAR (SEQ ID NO: 6037) | GDWHYFDY (SEQ ID NO: 7315) | WGQGTMVTVSS (SEQ ID NO: 6006) |

TABLE 8

Exemplary light chain CDRs and FWRs of NKp30-targeting antigen binding domains

| Ab ID | FWR1 | CDR1 | FWR2 | CDR2 | FWR3 | CDR3 | FWR4 |
|---|---|---|---|---|---|---|---|
| 9G1-LC | SYTLTQPPLLSVALGHKATITC (SEQ ID NO: 6066) | SGERLSDKYVH (SEQ ID NO: 6063) | WYQQKPGRAPVMVIY (SEQ ID NO: 6067) | ENDKRPS (SEQ ID NO: 6064) | GIPDQFSGSNSGNIATLTISKAQAGYEADYYC (SEQ ID NO: 7292) | QSWDSTNSAV (SEQ ID NO: 7293) | FGSGTQLTVL (SEQ ID NO: 6069) |
| 15H6-LC | SYTLTQPPSLSVAPGQKATIIC (SEQ ID NO: 6073) | SGENLSDKYVH (SEQ ID NO: 6070) | WYQQKPGRAPVMVIY (SEQ ID NO: 6074) | ENEKRPS (SEQ ID NO: 6071) | GIPDQFSGSNSGNIATLTISKAQPGSEADYYC (SEQ ID NO: 6075) | HYWESINSVV (SEQ ID NO: 6072) | FGSGTHLTVL (SEQ ID NO: 6076) |

TABLE 8-continued

Exemplary light chain CDRs and FWRs of NKp30-targeting antigen binding domains

| Ab ID | FWR1 | CDR1 | FWR2 | CDR2 | FWR3 | CDR3 | FWR4 |
|---|---|---|---|---|---|---|---|
| 9G1-LC_1 | QSVTTQPPSVSGAPGQRVTISC (SEQ ID NO: 6077) | SGERLSDKYVH (SEQ ID NO: 6063) | WYQQLPGTAPKMLIY (SEQ ID NO: 6078) | ENDKRPS (SEQ ID NO: 6064) | GVPDRFSGSNSGNSASLAITGLQAEDEADYYC (SEQ ID NO: 6079) | QSWDSTNSAV (SEQ ID NO: 7293) | FGGGTQLTVL (SEQ ID NO: 6080) |
| 9G1-LC_2 | QSVTTQPPSASGTPGQRVTISC (SEQ ID NO: 6081) | SGERLSDKYVH (SEQ ID NO: 6063) | WYQQLPGTAPKMLIY (SEQ ID NO: 6082) | ENDKRPS (SEQ ID NO: 6064) | GVPDRFSGSNSGNSASLAISGLQSEDEADYYC (SEQ ID NO: 6083) | QSWDSTNSAV (SEQ ID NO: 7293) | FGGGTQLTVL (SEQ ID NO: 6084) |
| 9G1-LC_3 | QSVTTQPPSASGTPGQRVTISC (SEQ ID NO: 6085) | SGERLSDKYVH (SEQ ID NO: 6063) | WYQQLPGTAPKMLIY (SEQ ID NO: 6086) | ENDKRPS (SEQ ID NO: 6064) | GVPDRFSGSNSGNSASLAISGLRSEDEADYYC (SEQ ID NO: 6087) | QSWDSTNSAV (SEQ ID NO: 7293) | FGGGTQLTVL (SEQ ID NO: 6088) |
| 9G1-LC_4 | SSETTQPHSVSVATAQMARITC (SEQ ID NO: 6089) | SGERLSDKYVH (SEQ ID NO: 6063) | WYQQKPGQDPVMVIY (SEQ ID NO: 6090) | ENDKRPS (SEQ ID NO: 6064) | GIPERFSGSNPGNTATLTISRIEAGDEADYYC (SEQ ID NO: 6091) | QSWDSTNSAV (SEQ ID NO: 7293) | FGGGTQLTVL (SEQ ID NO: 6092) |
| 9G1-LC_5 | DIQMTQSPSTLSASVGDRVTITC (SEQ ID NO: 6093) | SGERLSDKYVH (SEQ ID NO: 6063) | WYQQKPGKAPKMLIY (SEQ ID NO: 6094) | ENDKRPS (SEQ ID NO: 6064) | GVPSRFSGSNSGNEATLTISSLQPDDFATYYC (SEQ ID NO: 6095) | QSWDSTNSAV (SEQ ID NO: 7293) | FGQGTKVEIK (SEQ ID NO: 6096) |
| 15H6-LC_1 | QYVLTQPPSASGTPGQRVTISC (SEQ ID NO: 6097) | SGENLSDKYVH (SEQ ID NO: 6070) | WYQQLPGTAPKMLIY (SEQ ID NO: 6098) | ENEKRPS (SEQ ID NO: 6071) | GVPDRFSGSNSGNSASLAISGLQSEDEADYYC (SEQ ID NO: 6099) | HYWESINSVV (SEQ ID NO: 6072) | FGEGTELTVL (SEQ ID NO: 6100) |
| 15H6-LC_2 | QYVLTQPPSASGTPGQRVTISC (SEQ ID NO: 6101) | SGENLSDKYVH (SEQ ID NO: 6070) | WYQQLPGTAPKMLIY (SEQ ID NO: 6102) | ENEKRPS (SEQ ID NO: 6071) | GVPDRFSGSNSGNSASLAISGLRSEDEADYYC (SEQ ID NO: 6103) | HYWESINSVV (SEQ ID NO: 6072) | FGEGTELTVL (SEQ ID NO: 6104) |
| 15H6-LC_3 | SYELTQPPSVSVSPGQTASITC (SEQ ID NO: 6105) | SGENLSDKYVH (SEQ ID NO: 6070) | WYQQKPGQSPVMVIY (SEQ ID NO: 6106) | ENEKRPS (SEQ ID NO: 6071) | GIPERFSGSNSGNTATLTISGTQAMDEADYYC (SEQ ID NO: 6107) | HYWESINSVV (SEQ ID NO: 6072) | FGEGTELTVL (SEQ ID NO: 6108) |
| 15H6-LC_4 | DYVLTQSPLSLPVTPGEPASISC (SEQ ID NO: 6109) | SGENLSDKYVH (SEQ ID NO: 6070) | WYLQKPGQSPQMLIY (SEQ ID NO: 6110) | ENEKRPS (SEQ ID NO: 6071) | GVPDRFSGSNSGNDATLKISRVEAEDVGVYYC (SEQ ID NO: 6111) | HYWESINSVV (SEQ ID NO: 6072) | FGGGTKVEIK (SEQ ID NO: 6112) |
| 15H6-LC_5 | AYQLTQSPSSLSASVGDRVTITC (SEQ ID NO: 6113) | SGENLSDKYVH (SEQ ID NO: 6070) | WYQQKPGKAPKMLIY (SEQ ID NO: 6114) | ENEKRPS (SEQ ID NO: 6071) | GVPSRFSGSNSGNDATLTISSLQPEDFATYYC (SEQ ID NO: 6115) | HYWESINSVV (SEQ ID NO: 6072) | FGGGTKVEIK (SEQ ID NO: 6116) |
| 15H6-LC_6 | EYVLTQSPATLSVSPGERATLSC (SEQ ID NO: 6117) | SGENLSDKYVH (SEQ ID NO: 6070) | WYQQKPGQAPRMLIY (SEQ ID NO: 6118) | ENEKRPS (SEQ ID NO: 6071) | GIPARFSGSNSGNEATLTISSLQSEDFAVYYC (SEQ ID NO: 6119) | HYWESINSVV (SEQ ID NO: 6072) | FGGGTKVEIK (SEQ ID NO: 6120) |

TABLE 8-continued

Exemplary light chain CDRs and FWRs of NKp30-targeting antigen binding domains

| Ab ID | FWR1 | CDR1 | FWR2 | CDR2 | FWR3 | CDR3 | FWR4 |
|---|---|---|---|---|---|---|---|
| 9D9-LC | SYTLTQPPLVSVALGQKATIIC (SEQ ID NO: 7320) | SGENLSDKYVH (SEQ ID NO: 6070) | WYQQKPGRAPVMVIY (SEQ ID NO: 6067) | ENDKRPS (SEQ ID NO: 6064) | GIPDQFSGSNSGNIATLTISKAQAGYEADYYC (SEQ ID NO: 7292) | HCWDSTNSAV (SEQ ID NO: 7321) | FGSGTHLTVL (SEQ ID NO: 6076) |
| 3A12-LC | SYTLTQPPLVSVALGQKATIIC (SEQ ID NO: 7320) | SGENLSDKYVH (SEQ ID NO: 6070) | WYQQKPGRAPVMVIY (SEQ ID NO: 6067) | ENDKRPS (SEQ ID NO: 6064) | GIPDQFSGSNSGNIATLTISKAQAGYEADYYC (SEQ ID NO: 7292) | HCWDSTNSAV (SEQ ID NO: 7321) | FGSGTHLTVL (SEQ ID NO: 6076) |
| 12D10-LC | SYTLTQPPSLSVAPGQKATIIC (SEQ ID NO: 6073) | SGENLSDKYVH (SEQ ID NO: 6070) | WYQQKPGRAPVMVIY (SEQ ID NO: 6074) | ENEKRPS (SEQ ID NO: 6071) | GIPDQFSGSNSGNIATLTISKAQPGSEADYYC (SEQ ID NO: 6075) | HYWESINSVV (SEQ ID NO: 6072) | FGSGTHLTVL (SEQ ID NO: 6076) |
| 15E1-LC | SFTLTQPPLVSVAVGQVATITC (SEQ ID NO: 7325) | SGEKLSDKYVH (SEQ ID NO: 7326) | WYQQKPGRAPVMVIY (SEQ ID NO: 6067) | ENDRRPS (SEQ ID NO: 7327) | GIPDQFSGSNSGNIASLTISKAQAGDEADYFC (SEQ ID NO: 7328) | QFWDSTNSAV (SEQ ID NO: 7329) | FGGGTQLTVL (SEQ ID NO: 6080) |
| 15E1_Humanized variant_VL1 | SSETTQPPSVSVSPGQTASITC (SEQ ID NO: 7335) | SGEKLSDKYVH (SEQ ID NO: 7326) | WYQQKPGQSPVMVIY (SEQ ID NO: 6106) | ENDRRPS (SEQ ID NO: 7327) | GIPERFSGSNSGNTATLTISGTQAMDEADYFC (SEQ ID NO: 7336) | QFWDSTNSAV (SEQ ID NO: 7329) | FGGGTQLTVL (SEQ ID NO: 6080) |
| 15E1_Humanized variant_VL2 | SSETTQPHSVSVATAQMARITC (SEQ ID NO: 6089) | SGEKLSDKYVH (SEQ ID NO: 7326) | WYQQKPGQDPVMVIY (SEQ ID NO: 6090) | ENDRRPS (SEQ ID NO: 7327) | GIPERFSGSNPGNTATLTISRIEAGDEADYFC (SEQ ID NO: 7337) | QFWDSTNSAV (SEQ ID NO: 7329) | FGGGTQLTVL (SEQ ID NO: 6080) |
| 15E1_Humanized variant_VL3 | QSVTTQPPSASGTPGQRVTISC (SEQ ID NO: 6081) | SGEKLSDKYVH (SEQ ID NO: 7326) | WYQQLPGTAPKMLIY (SEQ ID NO: 6078) | ENDRRPS (SEQ ID NO: 7327) | GVPDRFSGSNSGNSASLAISGLRSEDEADYFC (SEQ ID NO: 7338) | QFWDSTNSAV (SEQ ID NO: 7329) | FGGGTQLTVL (SEQ ID NO: 6080) |
| 15E1_Humanized variant_VL4 | QSVTTQPPSVSGAPGQRVTISC (SEQ ID NO: 6077) | SGEKLSDKYVH (SEQ ID NO: 7326) | WYQQLPGTAPKMLIY (SEQ ID NO: 6078) | ENDRRPS (SEQ ID NO: 7327) | GVPDRFSGSNSGNSASLAITGLQAEDEADYFC (SEQ ID NO: 7339) | QFWDSTNSAV (SEQ ID NO: 7329) | FGGGTQLTVL (SEQ ID NO: 6080) |
| 15E1_Humanized variant_VL5 | DSVTTQSPLSLPVTLGQPASISC (SEQ ID NO: 7340) | SGEKLSDKYVH (SEQ ID NO: 7326) | WYQQRPGQSPRMLIY (SEQ ID NO: 7341) | ENDRRPS (SEQ ID NO: 7327) | GVPDRFSGSNSGNDATLKISRVEAEDVGVYFC (SEQ ID NO: 7342) | QFWDSTNSAV (SEQ ID NO: 7329) | FGGGTKVEIK (SEQ ID NO: 233) |

TABLE 9

Exemplary variable regions of NKp30-targeting antigen binding domains

| SEQ ID NO | Ab ID | Description | Sequence |
|---|---|---|---|
| SEQ ID NO: 6121 | 9G1-HC | 9G1 heavy chain variable region | QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSS |
| SEQ ID | 15H6-HC | 15H6 heavy chain variable region | QIQLQESGPGLVKPSQSLSLTCSVTGFSINTGGYHWNWIRQFPGKKLEWMGYIYSSGTTRYNPSLKSRISITRDT |

TABLE 9-continued

Exemplary variable regions of NKp30-targeting antigen binding domains

| SEQ ID NO | Ab ID | Description | Sequence |
|---|---|---|---|
| SEQ ID NO: 6122 | | | SKNQFFLQLNSVTPEDTATYYCTRGNWHYFDYWGQGTLVAVSS |
| SEQ ID NO: 6123 | 9G1-HC1 | 9G1 heavy chain variable region humanized variant 1 | QIQLQESGPGLVKPSETLSLTCTVSGFSINTGGYHWNWIRQPAGKGLEWIGYIYSSGSTSYNPSLKSRVTMSRDTSKNQFSLKLSSVTAADTAVYYCARGNWHYFDFWGQGTMVTVSS |
| SEQ ID NO: 6124 | 9G1-HC_2 | 9G1 heavy chain variable region humanized variant 2 | QIQLQESGPGLVKPSQTLSLTCTVSGFSINTGGYHWNWIRQHPGKGLEWIGYIYSSGSTSYNPSLKSLVTISRDTSKNQFSLKLSSVTAADTAVYYCARGNWHYFDFWGQGTMVTVSS |
| SEQ ID NO: 6125 | 9G1-HC_3 | 9G1 heavy chain variable region humanized variant 3 | EIQLLESGGGLVQPGGSLRLSCAVSGFSINTGGYHWNWVRQAPGKGLEWVGYIYSSGSTSYNPSLKSRFTISRDTSKNTFYLQMNSLRAEDTAVYYCARGNWHYFDFWGQGTMVTVSS |
| SEQ ID NO: 6126 | 9G1-HC_4 | 9G1 heavy chain variable region humanized variant 4 | QIQLVQSGAEVKKPGSSVKVSCKVSGFSINTGGYHWNWVRQAPGQGLEWMGYIYSSGSTSYNPSLKSRVTITRDTSTNTFYMELSSLRSEDTAVYYCARGNWHYFDFWGQGTMVTVSS |
| SEQ ID NO: 6127 | 9G1-HC_5 | 9G1 heavy chain variable region humanized variant 5 | EIQLVESGGGLVQPGGSLRLSCAVSGFSINTGGYHWNWVRQAPGKGLEWVGYIYSSGSTSYNPSLKSRFTISRDTAKNSFYLQMNSLRAEDTAVYYCARGNWHYFDFWGQGTMVTVSS |
| SEQ ID NO: 6128 | 9G1-HC_6 | 9G1 heavy chain variable region humanized variant 6 | QIQLVQSGAEVKKPGASVKVSCKVSGFSINTGGYHWNWVRQAPGQGLEWMGYIYSSGSTSYNPSLKSRVTMTRDTSTNTFYMELSSLRSEDTAVYYCARGNWHYFDFWGQGTMVTVSS |
| SEQ ID NO: 6129 | 15H6-HC1 | 15H6 heavy chain variable region humanized variant 1 | QIQLQESGPGLVKPSQTLSLTCTVSGFSINTGGYHWNWIRQHPGKGLEWIGYIYSSGTTRYNPSLKSLVTISRDTSKNQFSLKLSSVTAADTAVYYCARGNWHYFDYWGQGTLVTVSS |
| SEQ ID NO: 6130 | 15H6-HC_2 | 15H6 heavy chain variable region humanized variant 2 | QIQLQESGPGLVKPSETLSLTCTVSGFSINTGGYHWNWIRQPAGKGLEWIGYIYSSGTTRYNPSLKSRVTMSRDTSKNQFSLKLSSVTAADTAVYYCARGNWHYFDYWGQGTLVTVSS |
| SEQ ID NO: 6131 | 15H6-HC_3 | 15H6 heavy chain variable region humanized variant 3 | EIQLLESGGGLVQPGGSLRLSCAVSGFSINTGGYHWNWVRQAPGKGLEWVGYIYSSGTTRYNPSLKSRFTISRDTSKNTFYLQMNSLRAEDTAVYYCARGNWHYFDYWGQGTLVTVSS |
| SEQ ID NO: 6132 | 15H6-HC_4 | 15H6 heavy chain variable region humanized variant 4 | QIQLVESGGGLVKPGGSLRLSCAVSGFSINTGGYHWNWIRQAPGKGLEWVGYIYSSGTTRYNPSLKSRFTISRDTAKNSFYLQMNSLRAEDTAVYYCARGNWHYFDYWGQGTLVTVSS |
| SEQ ID NO: 6133 | 15H6-HC_5 | 15H6 heavy chain variable region humanized variant 5 | QIQLVQSGAEVKKPGASVKVSCKVSGFSINTGGYHWNWVRQAPGQGLEWMGYIYSSGTTRYNPSLKSRVTMTRDTSTNTFYMELSSLRSEDTAVYYCARGNWHYFDYWGQGTLVTVSS |
| SEQ ID NO: 6134 | 15H6-HC_6 | 15H6 heavy chain variable region humanized variant 6 | EIQLVQSGAEVKKPGATVKISCKVSGFSINTGGYHWNWVQQAPGKGLEWMGYIYSSGTTRYNPSLKSRVTITRDTSTNTFYMELSSLRSEDTAVYYCARGNWHYFDYWGQGTLVTVSS |
| SEQ ID NO: 7294 | 9G1-LC | 9G1 light chain variable region | SYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVL |
| SEQ ID NO: 6136 | 15H6-LC | 15H6 light chain variable region | SYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVL |
| SEQ ID NO: | 9G1-LC_1 | 9G1 light chain variable region | QSVTTQPPSVSGAPGQRVTISCSGERLSDKYVHWYQQLPGTAPKMLIYENDKRPSGVPDRFSGSNSGNSASLAIT |

TABLE 9-continued

Exemplary variable regions of NKp30-targeting antigen binding domains

| SEQ ID NO | Ab ID | Description | Sequence |
|---|---|---|---|
| SEQ ID NO: 6137 | | humanized variant 1 | GLQAEDEADYYCQSWDSTNSAVFGGGTQLTVL |
| SEQ ID NO: 6138 | 9G1-LC_2 | 9G1 light chain variable region humanized variant 2 | QSVTTQPPSASGTPGQRVTISCSGERLSDKYVHWYQQ LPGTAPKMLIYENDKRPSGVPDRFSGSNSGNSASLAIS GLQSEDEADYYCQSWDSTNSAVFGGGTQLTVL |
| SEQ ID NO: 6139 | 9G1-LC_3 | 9G1 light chain variable region humanized variant 3 | QSVTTQPPSASGTPGQRVTISCSGERLSDKYVHWYQQ LPGTAPKMLIYENDKRPSGVPDRFSGSNSGNSASLAIS GLRSEDEADYYCQSWDSTNSAVFGGGTQLTVL |
| SEQ ID NO: 6140 | 9G1-LC_4 | 9G1 light chain variable region humanized variant 4 | SSETTQPHSVSVATAQMARITCSGERLSDKYVHWYQ QKPGQDPVMVIYENDKRPSGIPERFSGSNPGNTATLTI SRIEAGDEADYYCQSWDSTNSAVFGGGTQLTVL |
| SEQ ID NO: 6141 | 9G1-LC_5 | 9G1 light chain variable region humanized variant 5 | DIQMTQSPSTLSASVGDRVTITCSGERLSDKYVHWYQ QKPGKAPKMLIYENDKRPSGVPSRFSGSNSGNEATLTI SSLQPDDFATYYCQSWDSTNSAVFGQGTKVEIK |
| SEQ ID NO: 6142 | 15H6-LC_1 | 15H6 light chain variable region humanized variant 1 | QYVLTQPPSASGTPGQRVTISCSGENLSDKYVHWYQQ LPGTAPKMLIYENEKRPSGVPDRFSGSNSGNSASLAIS GLQSEDEADYYCHYWESINSVVFGEGTELTVL |
| SEQ ID NO: 6143 | 15H6-LC_2 | 15H6 light chain variable region humanized variant 2 | QYVLTQPPSASGTPGQRVTISCSGENLSDKYVHWYQQ LPGTAPKMLIYENEKRPSGVPDRFSGSNSGNSASLAIS GLRSEDEADYYCHYWESINSVVFGEGTELTVL |
| SEQ ID NO: 6144 | 15H6-LC_3 | 15H6 light chain variable region humanized variant 3 | SYELTQPPSVSVSPGQTASITCSGENLSDKYVHWYQQ KPGQSPVMVIYENEKRPSGIPERFSGSNSGNTATLTISG TQAMDEADYYCHYWESINSVVFGEGTELTVL |
| SEQ ID NO: 6145 | 15H6-LC_4 | 15H6 light chain variable region humanized variant 4 | DYVLTQSPLSLPVTPGEPASISCSGENLSDKYVHWYL QKPGQSPQMLIYENEKRPSGVPDRFSGSNSGNDATLK ISRVEAEDVGVYYCHYWESINSVVFGQGTKVEIK |
| SEQ ID NO: 6146 | 15H6-LC_5 | 15H6 light chain variable region humanized variant 5 | AYQLTQSPSSLSASVGDRVTITCSGENLSDKYVHWYQ QKPGKAPKMLIYENEKRPSGVPSRFSGSNSGNDATLTI SSLQPEDFATYYCHYWESINSVVFGQGTKVEIK |
| SEQ ID NO: 6147 | 15H6-LC_6 | 15H6 light chain variable region humanized variant 6 | EYVLTQSPATLSVSPGERATLSCSGENLSDKYVHWYQ QKPGQAPRMLIYENEKRPSGIPARFSGSNSGNEATLTI SSLQSEDFAVYYCHYWESINSVVFGQGTKVEIK |
| SEQ ID NO: 7295 | 9D9-HC | 9D9 heavy chain variable region | QIQLQESGPGLVKPSQSLSLSCSVTGFSINTGGYHWN WIRQFPGKKVEWMGYIYSSGTTKYNPSLKSRISITRDT SKNQFFLQLNSVTTEDTATYYCARGDWHYFDYWGQ GTMVAVSS |
| SEQ ID NO: 7296 | 9D9-LC | 9D9 light chain variable region | SYTLTQPPLVSVALGQKATIICSGENLSDKYVHWYQQ KPGRAPVMVIYENDKRPSGIPDQFSGSNSGNIATLTIS KAQAGYEADYYCHCWDSTNSAVFGSGTHLTVL |
| SEQ ID NO: 7297 | 3A12-HC | 3A12 heavy chain variable region | QIQLQESGPGLVKPSQSLSLTCSVTGFSINTGGYHWN WIRQFPGKKLEWMGYIYSSGSTRYNPSLKSRFSITRDT SKNQFFLQLNSVTTEDTATYYCTRGNWHYFDYWGQ GTLVAVSS |
| SEQ ID NO: 7296 | 3A12-LC | 3A12 light chain variable region | SYTLTQPPLVSVALGQKATIICSGENLSDKYVHWYQQ KPGRAPVMVIYENDKRPSGIPDQFSGSNSGNIATLTIS KAQAGYEADYYCHCWDSTNSAVFGSGTHLTVL |
| SEQ ID NO: | 12D10-HC | 12D10 heavy chain variable region | QIQLQESGPGLVKPSQSLSLTCSVTGFSINTGGYHWN WIRQFPGKKLEWMGYIYSSGTTRYNPSLKSRISITRDT |

TABLE 9-continued

Exemplary variable regions of NKp30-targeting antigen binding domains

| SEQ ID NO | Ab ID | Description | Sequence |
|---|---|---|---|
| SEQ ID NO: 6122 | | | SKNQFFLQLNSVTPEDTATYYCTRGNWHYFDWGQGTLVAVSS |
| SEQ ID NO: 6136 | 12D10-LC | 12D10 light chain variable region | SYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVL |
| SEQ ID NO: 7298 | 15E1-HC | 15E1 heavy chain variable region | QIQLQESGPGLVKPSQSLSLSCSVTGFSITTTGYHWNWIRQFPGKKLEWMGYIYSSGSTSYNPSLKSRFSITRDTSKNQFFLQLNSVTTEDTATYYCARGDWHYFDYWGPGTMVTVSS |
| SEQ ID NO: 7299 | 15E1-LC | 15E1 light chain variable region | SFTLTQPPLVSVAVGQVATITCSGEKLSDKYVHWYQQKPGRAPVMVIYENDRRPSGIPDQFSGSNSGNIASLTISKAQAGDEADYFCQFWDSTNSAVFGGGTQLTVL |
| SEQ ID NO: 7300 | 15E1_Humanized_variant_VH1 | 15E1 heavy chain variable region humanized variant 1 | QIQLQESGPGLVKPSQTLSLTCTVSGFSITTTGYHWNWIRQHPGKGLEWIGYIYSSGSTSYNPSLKSLVTISRDTSKNQFSLKLSSVTAADTAVYYCARGDWHYFDYWGQGTMVTVSS |
| SEQ ID NO: 7301 | 15E1_Humanized_variant_VH2 | 15E1 heavy chain variable region humanized variant 2 | QIQLVESGGGLVKPGGSLRLSCAVSGFSITTTGYHWNWIRQAPGKGLEWVGYIYSSGSTSYNPSLKSRFTISRDTAKNSFYLQMNSLRAEDTAVYYCARGDWHYFDYWGQGTMVTVSS |
| SEQ ID NO: 7302 | 15E1_Humanized_variant_VH3 (BJM0407 VH and BJM0411 VH) | 15E1 heavy chain variable region humanized variant 3 | EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSS |
| SEQ ID NO: 7303 | 15E1_Humanized_variant_VH4 | 15E1 heavy chain variable region humanized variant 4 | EIQLVESGGGLVQPGGSLRLSCAVSGFSITTTGYHWNWVRQAPGKGLEWVGYIYSSGSTSYNPSLKSRFTISRDTAKNSFYLQMNSLRAEDTAVYYCARGDWHYFDYWGQGTMVTVSS |
| SEQ ID NO: 7304 | 15E1_Humanized_variant_VH5 | 15E1 heavy chain variable region humanized variant 5 | QIQLVQSGAEVKKPGASVKVSCKVSGFSITTTGYHWNWVRQAPGQGLEWMGYIYSSGSTSYNPSLKSRVTMTRDTSTNTFYMELSSLRSEDTAVYYCARGDWHYFDYWGQGTMVTVSS |
| SEQ ID NO: 7305 | 15E1_Humanized_variant_VL1 (BJM0407 VL) | 15E1 light chain variable region humanized variant 1 | SSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVL |
| SEQ ID NO: 7306 | 15E1_Humanized_variant_VL2 | 15E1 light chain variable region humanized variant 2 | SSETTQPHSVSVATAQMARITCSGEKLSDKYVHWYQQKPGQDPVMVIYENDRRPSGIPERFSGSNPGNTATLTISRIEAGDEADYFCQFWDSTNSAVFGGGTQLTVL |
| SEQ ID NO: 7307 | 15E1_Humanized_variant_VL3 | 15E1 light chain variable region humanized variant 3 | QSVTTQPPSASGTPGQRVTISCSGEKLSDKYVHWYQQLPGTAPKMLIYENDRRPSGVPDRFSGSNSGNSASLAISGLRSEDEADYFCQFWDSTNSAVFGGGTQLTVL |
| SEQ ID NO: 7308 | 15E1_Humanized_variant_VL4 | 15E1 light chain variable region humanized variant 4 | QSVTTQPPSVSGAPGQRVTISCSGEKLSDKYVHWYQQLPGTAPKMLIYENDRRPSGVPDRFSGSNSGNSASLAITGLQAEDEADYFCQFWDSTNSAVFGGGTQLTVL |
| SEQ ID NO: | 15E1_Humanized | 15E1 light chain variable region | DSVTTQSPLSLPVTLGQPASISCSGEKLSDKYVHWYQQRPGQSPRMLIYENDRRPSGVPDRFSGSNSGNDATLKI |

TABLE 9-continued

Exemplary variable regions of NKp30-targeting antigen binding domains

| SEQ ID NO | Ab ID | Description | Sequence |
|---|---|---|---|
| SEQ ID NO: 7309 | variant_VL5 (BJM0411 VL) | humanized variant 5 | SRVEAEDVGVYFCQFWDSTNSAVFGGGTKVEIK |

TABLE 10

Exemplary NKp30-targeting antigen binding domains/antibody molecules

| SEQ ID NO | Ab ID | Description | Sequence |
|---|---|---|---|
| SEQ ID NO: 6148 | Ch(anti-NKp30 9G1)HC N297A | 9G1 heavy chain | QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK |
| SEQ ID NO: 6149 | Ch(anti-NKp30 9G1)HC | 9G1 heavy chain | QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK |
| SEQ ID NO: 6150 | Ch(anti-NKp30 9G1)LC | 9G1 light chain | SYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS |
| SEQ ID NO: 6151 | Ch(anti-NKp30 15H6)HC N297A | 15H6 heavy chain | QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK |
| SEQ ID NO: 6152 | Ch(anti-NKp30 15H6)HC (hole) | 15H6 heavy chain | QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK |
| SEQ ID NO: 6153 | Ch(anti-NKp30 15H6)LC | 15H6 light chain | SYTLTQPPLSVAPGQKATIICSGENLSDKYVHWYQQKPGRAPVMVIYENEKRPSGIPDQFSGSNSGNIATLTISKAQPGSEADYYCHYWESINSVVFGSGTHLTVLGQPKANPTVTLFPPSSEELQ |

TABLE 10-continued

Exemplary NKp30-targeting antigen binding domains/antibody molecules

| SEQ ID NO | Ab ID | Description | Sequence |
|---|---|---|---|
| | | | ANKATLVCLISDFYPGAVTVAWKADGSPVKAGVETTKPSKQ SNNKYAASSYLSLTPEQWKSHRSYSCQVTHEGSTVEKTVAPT ECS |
| SEQ ID NO: 6187 | anti-NKp30 9G1 scFv (VH-VL) | Hamster anti-NKp30 scFv of 9G1 in VH to VL orientation | QIQLQESGPGLVKPSQSLSLTCSVTGFSINTGGYHWNWIRQFP GKKLEWMGYIYSSGSTSYNPSLKSRISITRDTSKNQFFLQLNS VTTEDTATYYCARGNWHYFDFWGQGTMVTVSSGGGGSGG GGSGGGGSGGGGSSYTLTQPPLLSVALGHKATITCSGERLSD KYVHWYQQKPGRAPVMVIYENDKRPSGIPDQFSGSNSGNIAT LTISKAQAGYEADYYCQSWDSTNSAVFGSGTQLTVL |
| SEQ ID NO: 6188 | anti-NKp30 9G1 scFv (VL-VH) | Hamster anti-NKp30 scFv of 9G1 in VL to VH orientation | SYTLTQPPLLSVALGHKATITCSGERLSDKYVHWYQQKPGRA PVMVIYENDKRPSGIPDQFSGSNSGNIATLTISKAQAGYEADY YCQSWDSTNSAVFGSGTQLTVLGGGGSGGGGSGGGGSGGG GSQIQLQESGPGLVKPSQSLSLTCSVTGFSINTGGYHWNWIRQ FPGKKLEWMGYIYSSGSTSYNPSLKSRISITRDTSKNQFFLQL NSVTTEDTATYYCARGNWHYFDFWGQGTMVTVSS |
| SEQ ID NO: 6189 | anti-NKp30 15H6 scFv (VH-VL) | Hamster anti-NKp30 scFv of 15H6 in VH to VL orientation | QIQLQESGPGLVKPSQSLSLTCSVTGFSINTGGYHWNWIRQFP GKKLEWMGYIYSSGTTRYNPSLKSRISITRDTSKNQFFLQLNS VTPEDTATYYCTRGNWHYFDYWGQGTLVAVSSGGGGSGGG GSGGGGSGGGGSSYTLTQPPSLSVAPGQKATIICSGENLSDKY VHWYQQKPGRAPVMVIYENEKRPSGIPDQFSGSNSGNIATLTI SKAQPGSEADYYCHYWESINSVVFGSGTHLTVL |
| SEQ ID NO: 6190 | anti-NKp30 15H6 scFv (VL-VH) | Hamster anti-NKp30 scFv of 15H6 in VL to VH orientation | SYTLTQPPSLSVAPGQKATIICSGENLSDKYVHWYQQKPGRA PVMVIYENEKRPSGIPDQFSGSNSGNIATLTISKAQPGSEADY YCHYWESINSVVFGSGTHLTVLGGGGSGGGGSGGGGSGGGG SQIQLQESGPGLVKPSQSLSLTCSVTGFSINTGGYHWNWIRQF PGKKLEWMGYIYSSGTTRYNPSLKSRISITRDTSKNQFFLQLN SVTPEDTATYYCTRGNWHYFDYWGQGTLVAVSS |
| SEQ ID NO: 7310 | BJM0859 lambda scFv | | EIQLLESGGGLVQPGGSLRLSCAVSGFSITTTGYHWNWVRQA PGKGLEWVGYIYSSGSTSYNPSLKSRFTISRDTSKNTFYLQMN SLRAEDTAVYYCARGDWHYFDYWGQGTMVTVSSGGGGSG GGGSGGGGSGGGGSSSETTQPPSVSVSPGQTASITCSGEKLSD KYVHWYQQKPGQSPVMVIYENDRRPSGIPERFSGSNSGNTAT LTISGTQAMDEADYFCQFWDSTNSAVFGGGTQLTVL |
| SEQ ID NO: 7311 | BJM0860 kappa scFv | | EIQLLESGGGLVQPGGSLRLSCAVSGFSITTTGYHWNWVRQA PGKGLEWVGYIYSSGSTSYNPSLKSRFTISRDTSKNTFYLQMN SLRAEDTAVYYCARGDWHYFDYWGQGTMVTVSSGGGGSG GGGSGGGGSGGGGSDSVTTQSPLSLPVTLGQPASISCSGEKLS DKYVHWYQQRPGQSPRMLIYENDRRPSGVPDRFSGSNSGND ATLKISRVEAEDVGVYFCQFWDSTNSAVFGGGTKVEIK |

In some embodiments, the NK cell engager is an antigen binding domain that binds to NKp46 (e.g., NKp46 present, e.g., expressed or displayed, on the surface of an NK cell) and comprises any CDR amino acid sequence, framework region (FWR) amino acid sequence, or variable region amino acid sequence disclosed in Table 15. In some embodiments, binding of the NK cell engager, e.g., antigen binding domain that binds to NKp46, to the NK cell activates the NK cell. An antigen binding domain that binds to NKp46 (e.g., NKp46 present, e.g., expressed or displayed, on the surface of an NK cell) may be said to target NKp46, the NK cell, or both.

In some embodiments, the NK cell engager is an antigen binding domain that binds to NKG2D (e.g., NKG2D present, e.g., expressed or displayed, on the surface of an NK cell) and comprises any CDR amino acid sequence, framework region (FWR) amino acid sequence, or variable region amino acid sequence disclosed in Table 15. In some embodiments, binding of the NK cell engager, e.g., antigen binding domain that binds to NKG2D, to the NK cell activates the NK cell. An antigen binding domain that binds to NKG2D (e.g., NKG2D present, e.g., expressed or displayed, on the surface of an NK cell) may be said to target NKG2D, the NK cell, or both.

In some embodiments, the NK cell engager is an antigen binding domain that binds to CD16 (e.g., CD16 present, e.g., expressed or displayed, on the surface of an NK cell) and comprises any CDR amino acid sequence, framework region (FWR) amino acid sequence, or variable region amino acid sequence disclosed in Table 15. In some embodiments, binding of the NK cell engager, e.g., antigen binding domain that binds to CD16, to the NIK cell activates the NIK cell. An antigen binding domain that binds to CD16 (e.g., CD16 present, e.g., expressed or displayed, on the surface of an NIK cell) may be said to target CD16, the NIK cell, or both.

TABLE 15

Exemplary variable regions of NKp46, NKG2D, or CD16-targeting antigen binding domains

| SEQ ID NO | Ab ID | Description | Sequence |
|---|---|---|---|
| SEQ ID NO: 6175 | NKG2D_1scFv | scFv that binds NKG2D | QVHLQESGPGLVKPSETLSLTCTVSDDSISSYYWSWIRQPPG KGLEWIGHISYSGSANYNPSLKSRVTISVDTSKNQFSLKLSSV TAADTAVYYCANWDDAFNIWGQGTMVTVSSGGGGSGGGG SGGGGSGGGGSEIVLTQSPGTLSLSPGERATLSCRASQSVSSS YLAWYQQKPGQAPRLLIYGASSRATGIPDRFSGSGSGTDFTL TISRLEPEDFAVYYCQQYGSSPWTFGQGTKVEIK |
| SEQ ID NO: 6176 | NKG2D_1VH | VH that binds NKG2D | QVHLQESGPGLVKPSETLSLTCTVSDDSISSYYWSWIRQPPG KGLEWIGHISYSGSANYNPSLKSRVTISVDTSKNQFSLKLSSV TAADTAVYYCANWDDAFNIWGQGTMVTVSS |
| SEQ ID NO: 6177 | NKG2D_1VL | VL that binds NKG2D | EIVLTQSPGTLSLSPGERATLSCRASQSVSSSYLAWYQQKPG QAPRLLIYGASSRATGIPDRFSGSGSGTDFTLTISRLEPEDFAV YYCQQYGSSPWTFGQGTKVEIK |
| SEQ ID NO: 6178 | NKG2D_2scFv | scFv that binds NKG2D | EVQLVQSGAEVKEPGESLKISCKNSGYSFTNYWVGWVRQM PGKGLEWMGIIYPGDSDTRYSPSFQGQVTISADKSINTAYLQ WSSLKASDTAMYYCGRLTMFRGIIIGYFDYWGQGTLVTVSS GGGGSGGGGSGGGGSGGGGSEIVLTQSPATLSLSPGERATLS CRASQSVSSYLAWYQQKPGQAPRLLIYDASNRATGIPARFS GSGSGTDFTLTISSLEPEDFAVYYCQQRSNWPWTFGQGTKV EIK |
| SEQ ID NO: 6179 | NKG2D_2VH | VH that binds NKG2D | EVQLVQSGAEVKEPGESLKISCKNSGYSFTNYWVGWVRQM PGKGLEWMGIIYPGDSDTRYSPSFQGQVTISADKSINTAYLQ WSSLKASDTAMYYCGRLTMFRGIIIGYFDYWGQGTLVTVSS |
| SEQ ID NO: 6180 | NKG2D_2VL | VL that binds NKG2D | EIVLTQSPATLSLSPGERATLSCRASQSVSSYLAWYQQKPGQ APRLLIYDASNRATGIPARFSGSGSGTDFTLTISSLEPEDFAV YYCQQRSNWPWTFGQGTKVEIK |
| SEQ ID NO: 6181 | NKp46 scFv | scFv that binds NKp46 | QVQLQQSGPELVKPGASVKMSCKASGYTFTDYVINWGKQR SGQGLEWIGEIYPGSGTNYYNEKFKAKATLTADKSSNIAYM QLSSLTSEDSAVYFCARRGRYGLYAMDYWGQGTSVTVSSG GGGSGGGGSGGGGSGGGGSDIQMTQTTSSLSASLGDRVTIS CRASQDISNYLNWYQQKPDGTVKLLIYYTSRLHSGVPSRFS GSGSGTDYSLTINNLEQEDIATYFCQQGNTRPWTFGGGTKL EIK |
| SEQ ID NO: 6182 | NKp46VH | VH that binds NKp46 | QVQLQQSGPELVKPGASVKMSCKASGYTFTDYVINWGKQR SGQGLEWIGEIYPGSGTNYYNEKFKAKATLTADKSSNIAYM QLSSLTSEDSAVYFCARRGRYGLYAMDYWGQGTSVTVSS |
| SEQ ID NO: 6183 | NKp46VL | VL that binds NKp46 | DIQMTQTTSSLSASLGDRVTISCRASQDISNYLNWYQQKPDG TVKLLIYYTSRLHSGVPSRFSGSGSGTDYSLTINNLEQEDIAT YFCQQGNTRPWTFGGGTKLEIK |
| SEQ ID NO: 6184 | CD16 scFv | scFv that binds CD16 | EVQLVESGGGVVRPGGSLRLSCAASGFTFDDYGMSWVRQA PGKGLEWVSGINWNGGSTGYADSVKGRFTISRDNAKNSLY LQMNSLRAEDTAVYYCARGRSLLFDYWGQGTLVTVSRGG GSGGGGSGGGGSELTQDPAVSVALGQTVRITCQGDSLRS YYASWYQQKPGQAPVLVIYGKNNRPSGIPDRFSGSSSGNTA SLTITGAQAEDEADYYCNSRDSSGNHVVFGGGTKLTVL |
| SEQ ID NO: 6185 | CD16VH | VH that binds CD16 | EVQLVESGGGVVRPGGSLRLSCAASGFTFDDYGMSWVRQA PGKGLEWVSGINWNGGSTGYADSVKGRFTISRDNAKNSLY LQMNSLRAEDTAVYYCARGRSLLFDYWGQGTLVTVSR |
| SEQ ID NO: 6186 | CD16VL | VL that binds CD16 | SSELTQDPAVSVALGQTVRITCQGDSLRSYYASWYQQKPGQ APVLVIYGKNNRPSGIPDRFSGSSSGNTASLTITGAQAEDEA DYYCNSRDSSGNHVVFGGGTKLTVL |

In one embodiment, the NK cell engager is a ligand of NKp30, e.g., is a B7-6, e.g., comprises the amino acid sequence of: DLKVEMMAGGTQITPLNDNVTIFCNI-FYSQPLNITSMGITWFWKSLTFDKEVKVFEFFGD HQEAFRPGAIVSPWRLKSGDASLRLPGIQLEEAGEY-RCEVVVTPLKAQGTVQLEVVASP ASRLLL-DQVGMKENEDKYMCESSGFYPEAINIT-WEKQTQKFPHPIEISEDVITGPTIKNM DGTFNVTSCLKLNSSQEDPGTVYQCVVRHASLHTPL RSNFTLTAARHSLSETEKTDNFS (SEQ ID NO: 7233), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7233.

In other embodiments, the NK cell engager is a ligand of NKp44 or NKp46, which is a viral HA. Viral hemagglutinins (HA) are glyco proteins which are on the surface of viruses. HA proteins allow viruses to bind to the membrane of cells via sialic acid sugar moieties which contributes to the fusion of viral membranes with the cell membranes (see e.g., Eur J Immunol. 2001 September; 31(9):2680-9 "Recognition of viral hemagglutinins by NKp44 but not by NKp30"; and Nature. 2001 Feb. 22; 409(6823):1055-60 "Recognition of haemagglutinins on virus-infected cells by NKp46 activates lysis by human NK cells" the contents of each of which are incorporated by reference herein).

In other embodiments, the NK cell engager is a ligand of NKG2D chosen from MICA, MICB, or ULBP1, e.g., wherein:
  (i) MICA comprises the amino acid sequence: EPHSL-RYNLTVLSWDGSVQSGFLTEVHLDGQP-FLRCDRQKCRAKPQGQWAEDVLGNK TWDRETRDLTGNGKDLRMTLAHIKDQKEG-LHSLQEIRVCEIHEDNSTRSSQHFYYDGEL FLSQNLETKEWTMPQSSRAQTLAMNVRNFLKE-DAMKTKTHYHAMHADCLQELRRYLK SGVVLRRTVPPMVNVTRSEASEGNITVT-CRASGFYPWNITLSWRQDGVSLSHDTQQWG DVLPDGNGTYQTWVATRICQGEEQRFT-CYMEHSGNHSTHPVPSGKVLVLQSHW (SEQ ID NO: 7234), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7234;
  (ii) MICB comprises the amino acid sequence: AEPHSL-RYNLMVL SQDESVQSGFLAEGHLDGQPFLRY-DRQKRRAKPQGQWAEDVLGA KTWDTET-EDLTENGQDLRRTLTHIKDQKGGLHSLQEIRVCE-HiEDSSTRGSRHFYYDGEL FLSQNLETQESTVPQSSRAQTLAMNVTNFWKE-DAMKTKTHYRAMQADCLQKLQRYLK SGVAIRRTVPPMVNVTCSEVSEGNITVT-CRASSFYPRNITLTWRQDGVSLSHNTQQWGD VLPDGNGTYQTWVATRIRQGEEQRFT-CYMEHSGNHGTHPVPSGKVLVLQSQRTD (SEQ ID NO: 7235), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7235; or
  (iii) ULBP1 comprises the amino acid sequence: GWVDTHCLCYDFIITPKSRPEPQWCE-VQGLVDERPFLHYDCVNHKAKAFASLGKKVNV TKTWEEQTETLRDVVDFLKGQLLDIQVENLIPIE-PLTLQARMSCEHEAHGHGRGSWQFL FNGQKFLLFDSNNRKWTALHPGAKKMTEK-WEKNRDVTMFFQKISLGDCKMWLEEFL MYWEQMLDPTKPPSLAPG (SEQ ID NO: 7236), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7236.

In other embodiments, the NK cell engager is a ligand of DNAM1 chosen from NECTIN2 or NECL5, e.g., wherein:
  (i) NECTIN2 comprises the amino acid sequence: QDVRVQVLPEVRGQLGGTVELPCHLLPPVPGLY-ISLVTWQRPDAPANHQNVAAFHPKM GPSFPSPKPGSERL SFVSAKQSTGQDTEAELQ-DATLALHGLTVEDEGNYTCEFATFPKGS VRGMTWLRVIAKPKNQAEA-QKVTFSQDPTTVALCISKEGRPPARISWL SSLDWEAKETQ VSGTLAGTVTVTSRFTLVPS-GRADGVTVTCKVEHESFEEPALIPVTLSVRYPPE-VSISGYD DNWYLGRTDATLSCDVRSN-PEPTGYDWSTTSGTFPTSAVAQGSQLVIHAVDSL FNTTFV CTVTNAVGMGRAEQVIFVRETPN-TAGAGATGG (SEQ ID NO: 7237), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7237; or
  (ii) NECL5 comprises the amino acid sequence: WPPPGTGDVVVQAPTQVPGFLGDSVTLPCYLQ VPNMEVTHVSQLTWARHGESGSMAV FHQTQGPSYSESKRLEFVAARLGAELR-NASLRMFGLRVEDEGNYTCLFVTFPQGSRSVD IWLRVLAKPQNTAEVQKVQLTGEPVP-MARCVSTGGRPPAQITWHSDLGGMPNTSQVPG FLSGTVTVTSLWILVPSSQVDGKNVTCKVEHES-FEKPQLLTVNLTVYYPPEVSISGYDNN WYLGQNEATLTCDARSNPEPTGYNWSTTMG-PLPPFAVAQGAQLLIRPVDKPINTTLICN VTNAL-GARQAELTVQVKEGPPSEHSGISRN (SEQ ID NO: 7238), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7238.

In yet other embodiments, the NK cell engager is a ligand of DAP10, which is an adapter for NKG2D (see e.g., Proc Natl Acad Sci USA. 2005 May 24; 102(21): 7641-7646; and Blood, 15 Sep. 2011 Volume 118, Number 11, the full contents of each of which is incorporated by reference herein).

In other embodiments, the NK cell engager is a ligand of CD16, which is a CD16a/b ligand, e.g., a CD16a/b ligand further comprising an antibody Fc region (see e.g., Front Immunol. 2013; 4: 76 discusses how antibodies use the Fc to trigger NK cells through CD16, the full contents of which are incorporated herein).

In other embodiments, the NK cell engager is a ligand of CRTAM, which is NECL2, e.g., wherein NECL2 comprises the amino acid sequence: QNLFTKDVTVIEGEVATISCQVNKSDDSVIQLLNPNRQTIYFRDFRPLKDSRFQLLNFSSS ELKVSLTNVSISDEGRYFCQLYTDPPQESYTTITVLVPPRNLMIDIQKDTAVEGEEIEVNC TAMASKPATTIRWFKGNTELKGKSEVEEWSDMYTVTSQLMLKVHKEDDGVPVICQVE HPAVTGNLQTQRYLEVQYKPQVHIQMTYPLQGLTREGDALELTCEAIGKPQPVMVTWV RVDDEMPQHAVLSGPNLFINNLNKTDNGTYRCEASNIVGKAHSDYMLYVYDPPTTIPPP TTTTTTTTTTTTILTIITDSRAGEEGSIRAVDH (SEQ ID NO: 7239), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7239.

In other embodiments, the NK cell engager is a ligand of CD27, which is CD70, e.g., wherein CD70 comprises the amino acid sequence: QRFAQAQQQLPLESLGWDVAELQLNHTGPQQDPRLYWQGGPALGRSFLHGPELDKGQ LRIIHRDGIYMVHIQVTLAICSSTTASRHHPTTLAVGICSPASRSISLLRLSFHQGCTIASQR LTPLARGDTLCTNLTGTLLPSRNTDETFFGVQWVRP (SEQ ID NO: 7240), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7240.

In other embodiments, the NK cell engager is a ligand of PSGL1, which is L-selectin (CD62L), e.g., wherein L-selectin comprises the amino acid sequence: WTYHYSEKPMNWQRARRFCRDNYTDLVAIQNKAEIEYLEKTLPFSRSYYWIGIRKIGGI WTWVGTNKSLTEEAENWGDGEPNNKKNKEDCVEIYIKRNKDAGKWNDDACHKLKAA LCYTASCQPWSCSGHGECVEIINNYTCNCDVGYYGPQCQFVIQCEPLEAPELGTMDCTH PLGNFSFSSQCAFSCSEGTNLTGIEETTCGPFGNWSSPEPTCQVIQCEPLSAPDLGIMNCSH PLASFSFTSACTFICSEGTELIGKKKTICESSGIWSNPSPICQKLDKSFSMIKEGDYN (SEQ ID NO: 7241), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7241.

In other embodiments, the NK cell engager is a ligand of CD96, which is NECL5, e.g., wherein NECL5 comprises the amino acid sequence: WPPPGTGDVVVQAPTQVPGFLGDSVTLPCYLQVPNMEVTHVSQLTWARHGESGSMAV FHQTQGPSYSESKRLEFVAARLGAELRNASLRMFGLRVEDEGNYTCLFVTFPQGSRSVD IWLRVLAKPQNTAEVQKVQLTGEPVPMARCVSTGGRPPAQITWHSDLGGMPNTSQVPG FLSGTVTVTSLWILVPSSQVDGKNVTCKVEHESFEKPQLLTVNLTVYYPPEVSISGYDNN WYLGQNEATLTCDARSNPEPTGYNWSTTMGPLPPFAVAQGAQLLIRPVDKPINTTLICN VTNALGARQAELTVQVKEGPPSEHSGISRN (SEQ ID NO: 7238), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7238.

In other embodiments, the NK cell engager is a ligand of CD100 (SEMA4D), which is CD72, e.g., wherein CD72 comprises the amino acid sequence: RYLQVSQQLQQTNRVLEVTNSSLRQQLRLKITQLGQSAEDLQGSRRELAQSQEALQVEQ RAHQAAEGQLQACQADRQKTKETLQSEEQQRRALEQKLSNMENRLKPFFTCGSADTCC PSGWIMHQKSCFYISLTSKNWQESQKQCETLSSKLATFSEIYPQSHSYYFLNSLLPNGGS GNSYWTGLSSNKDWKLTDDTQRTRTYAQSSKCNKVHKTWSWWTLESESCRSSLPYICE MTAFRFPD (SEQ ID NO: 7242), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7242.

In other embodiments, the NK cell engager is a ligand of NKp80, which is CLEC2B (AICL), e.g., wherein CLEC2B (AICL) comprises the amino acid sequence: KLTRDSQSLCPYDWIGFQNKCYYFSKEEGDWNSSKYNCSTQHADLTIIDNIEEMNFLRR YKCSSDHWIGLKMAKNRTGQWVDGATFTKSFGMRGSEGCAYLSDDGAATARCYTER KWICRKRIH (SEQ ID NO: 7243), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7243.

In other embodiments, the NK cell engager is a ligand of CD244, which is CD48, e.g., wherein CD48 comprises the amino acid sequence: QGHLVHMTVVSGSNVTLNISESLPENYKQLTWFYTFDQKIVEWDSRKSKYFESKFKGR VRLDPQSGALYISKVQKEDNSTYIMRVLKKTGNEQEWKIKLQVLDPVPKPVIKIEKIEDM DDNCYLKLSCVIPGESVNYTWYGDKRPFPKELQNSVLETTLMPHNYSRCYTCQVSNSVS SKNGTVCLSPPCTLARS (SEQ ID NO: 7244), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7244.

In some embodiments, the NK cell engager is a viral hemagglutinin (HA), HA is a glycoprotein found on the surface of influenza viruses. It is responsible for binding the virus to cells with sialic acid on the membranes, such as cells in the upper respiratory tract or erythrocytes. HA has at least 18 different antigens. These subtypes are named H1 through H18. NCRs can recognize viral proteins. NKp46 has been shown to be able to interact with the HA of influenza and the HA-NA of Paramyxovirus, including Sendai virus and Newcastle disease virus. Besides NKp46, NKp44 can also functionally interact with HA of different influenza subtypes.

Death Receptor Signal Engagers

Death receptors, e.g., death receptors 4 and 5 (DR4 and DR5, also known as TRAIL-R1 and TRAIL-R2 respectively), are trimeric type I transmembrane proteins widely expressed in normal human tissues. Activation of death receptors causes intracellular signaling that induces cell death. TNF-related apoptosis-inducing ligand (TRAIL) (also known as Apo2L) is a trimeric protein that binds to Death receptors, activating their cell death-inducing signaling (Amarante-Mendes and Griffith. Pharmacol Ther. 2015 November; 155:117-31).

The present disclosure provides, inter alia, multispecific (e.g., bi-, tri-, quad-specific) or multifunctional molecules, that are engineered to contain one or more death receptor signal engagers that mediate binding to death receptors and/or activation of death receptor signaling on a target cell (e.g., a tumor antigen presenting cell (e.g., cancer cell, e.g., a lymphoma cell), or a lymphocyte expressing TRBC1 or TRBC2). Accordingly, in some embodiments, the death receptor signal engager comprises one or more TRAIL polypeptides or a fragment thereof (TRAIL molecule), one or more death receptors or a fragment thereof (death receptor molecule), or one or more antigen binding domains that specifically binds to a death receptor (e.g., and activates death receptor signaling). Without wishing to be bound by theory, it is thought that a death receptor signal engager that can activate death receptor signaling on a target cell can induce the death of the target cell, e.g., a target disease cell, e.g., a target cancer cell.

Death receptor signal engagers may comprise TRAIL molecules and/or death receptor molecules from or derived from versions of TRAIL and death receptors known to those skilled in the art. In some embodiments, the death receptor signal engager comprises a human TRAIL molecule or death receptor molecule. In some embodiments, the death receptor signal engager comprises a mouse TRAIL molecule or death receptor molecule. In some embodiments, the death receptor signal engager comprises a mammalian TRAIL molecule or death receptor molecule. In some embodiments, the death receptor signal engager comprises a truncated TRAIL molecule or death receptor molecule (e.g., relative to a wild-type TRAIL molecule or death receptor molecule).

In some embodiments, the death receptor signal engager comprises a truncated TRAIL molecule comprising at least residues corresponding to amino acids 95-281 of human TRAIL, e.g., a truncated TRAIL molecule comprising residues corresponding to amino acids 95-281 of human TRAIL. In some embodiments, the death receptor signal engager comprises a truncated TRAIL molecule comprising residues of 95-281 of human TRAIL.

In some embodiments, the death receptor signal engager comprises a truncated TRAIL molecule comprising at least residues corresponding to amino acids 122-281 of human TRAIL, e.g., a truncated TRAIL molecule comprising residues corresponding to amino acids 122-281 of human TRAIL. In some embodiments, the death receptor signal engager comprises a truncated TRAIL molecule comprising residues of 122-281 of human TRAIL.

In some embodiments, the death receptor signal engager comprises one, two, or three TRAIL molecules (e.g., the death receptor signal engager is a monomeric, dimeric, or trimeric TRAIL molecule, respectively). In some embodiments, the death receptor signal engager comprises one, two, or three death receptor molecules (e.g., the death receptor signal engager is a monomeric, dimeric, or trimeric death receptor molecule, respectively). In some embodiments, the death receptor signal engager comprises one, two, or three antigen binding domains that specifically bind to a death receptor (e.g., to one or more death receptors, e.g., the same or different death receptors)

In some embodiments, the death receptor signal engager comprises an amino acid sequence selected from Table 11 (or an amino acid sequence having at least about 77%, 80%, 85%, 90%, 95%, or 99% sequence identity to a sequence selected from Table 11).

In some embodiments, the death receptor signal engager comprises an amino acid sequence of SEQ ID NO: 6157 (or an amino acid sequence having at least about 77%, 80%, 85%, 90%, 95%, or 99% sequence identity to SEQ ID NO: 6157).

In some embodiments, the death receptor signal engager comprises an amino acid sequence of SEQ ID NO: 6158 (or an amino acid sequence having at least about 77%, 80%, 85%, 90%, 95%, or 99% sequence identity to SEQ ID NO: 6158).

In some embodiments, the death receptor signal engager comprises an amino acid sequence of SEQ ID NO: 6159 (or an amino acid sequence having at least about 77%, 80%, 85%, 90%, 95%, or 99% sequence identity to SEQ ID NO: 6159).

In some embodiments, the death receptor signal engager comprises an amino acid sequence of SEQ ID NO: 6160 (or an amino acid sequence having at least about 77%, 80%, 85%, 90%, 95%, or 99% sequence identity to SEQ ID NO: 6160).

In some embodiments, the death receptor signal engager comprises an amino acid sequence of SEQ ID NO: 6161 (or an amino acid sequence having at least about 77%, 80%, 85%, 90%, 95%, or 99% sequence identity to SEQ ID NO: 6161).

In some embodiments, the death receptor signal engager comprises an amino acid sequence of SEQ ID NO: 6162 (or an amino acid sequence having at least about 77%, 80%, 85%, 90%, 95%, or 99% sequence identity to SEQ ID NO: 6162).

In some embodiments, the death receptor signal engager comprises an amino acid sequence of SEQ ID NO: 6163 (or an amino acid sequence having at least about 77%, 80%, 85%, 90%, 95%, or 99% sequence identity to SEQ ID NO: 6163).

In some embodiments, the death receptor signal engager comprises an amino acid sequence of SEQ ID NO: 6164 (or an amino acid sequence having at least about 77%, 80%, 85%, 90%, 95%, or 99% sequence identity to SEQ ID NO: 6164).

In some embodiments, the death receptor signal engager comprises an amino acid sequence of SEQ ID NO: 6165 (or an amino acid sequence having at least about 77%, 80%, 85%, 90%, 95%, or 99% sequence identity to SEQ ID NO: 6165).

In some embodiments, the death receptor signal engager is comprised on the same polypeptide chain as another component of a multifunctional molecule of the present disclosure, e.g., the death receptor signal engager is comprised on the same polypeptide chain as a heavy and/or light chain of a first antigen binding domain that preferentially binds to a tumor antigen on a lymphoma cell (e.g., T cell), wherein the tumor antigen is T cell receptor beta chain constant domain 1 (TRBC1) or T cell receptor beta chain constant domain 2 (TRBC2), a heavy and/or light chain of a first antigen binding domain that selectively targets lymphocytes expressing T cell receptor beta chain constant domain 1 (TRBC1) or T cell receptor beta chain constant domain 2 (TRBC2), an immune cell engager, a cytokine molecule, or a stromal modified moiety, e.g., as a fusion protein. In some embodiments, the multifunctional molecule comprises a fusion protein comprising a death receptor signal engager and light chain of a first antigen binding domain that preferentially binds to a tumor antigen on a lymphoma cell (e.g., T cell), wherein the tumor antigen is T cell receptor beta chain constant domain 1 (TRBC1) or T cell receptor beta chain constant domain 2 (TRBC2). In some embodiments, the multifunctional molecule comprises a fusion protein comprising a death receptor signal engager and a light chain of a first antigen binding domain that selectively targets lymphocytes expressing T cell receptor beta chain constant domain 1 (TRBC1) or T cell receptor beta chain constant domain 2 (TRBC2).

In some embodiments, the fusion protein comprising a death receptor signal engager and a light chain of a first antigen binding domain targeting TRBC1 comprises an amino acid sequence of SEQ ID NO: 6170 (or an amino acid sequence having at least about 77%, 80%, 85%, 90%, 95%, or 99% sequence identity to SEQ ID NO: 6170).

In some embodiments, the fusion protein comprising a death receptor signal engager and a light chain of a first antigen binding domain targeting TRBC1 comprises an amino acid sequence of SEQ ID NO: 6171 (or an amino acid sequence having at least about 77%, 80%, 85%, 90%, 95%, or 99% sequence identity to SEQ ID NO: 6171).

In some embodiments, the fusion protein comprising a death receptor signal engager and a light chain of a first antigen binding domain targeting TRBC1 comprises an amino acid sequence of SEQ ID NO: 6172 (or an amino acid sequence having at least about 77%, 80%, 85%, 90%, 95%, or 99% sequence identity to SEQ ID NO: 6172).

In some embodiments, the multifunctional molecule comprises a fusion protein comprising a death receptor signal engager and a light chain of a first antigen binding domain targeting TRBC1 comprising an amino acid sequence of SEQ ID NO: 6170 (or an amino acid sequence having at least about 77%, 80%, 85%, 90%, 95%, or 99% sequence identity to SEQ ID NO: 6170), and a heavy chain of the first antigen binding domain targeting TRBC1 comprising an amino acid sequence of SEQ ID NO: 6167 (or an amino acid sequence having at least about 77%, 80%, 85%, 90%, 95%, or 99% sequence identity to SEQ ID NO: 6167). In some embodiments, the multifunctional molecule comprises a fusion protein comprising a death receptor signal engager and a light chain of a first antigen binding domain targeting TRBC1 comprising an amino acid sequence of SEQ ID NO: 6170 (or an amino acid sequence having at least about 77%, 80%, 85%, 90%, 95%, or 99% sequence identity to SEQ ID NO: 6170), and a heavy chain of the first antigen binding domain targeting TRBC1 comprising an amino acid sequence of SEQ ID NO: 6168 (or an amino acid sequence having at least about 77%, 80%, 85%, 90%, 95%, or 99% sequence identity to SEQ ID NO: 6168).

In some embodiments, the multifunctional molecule comprises a fusion protein comprising a death receptor signal engager and a light chain of a first antigen binding domain targeting TRBC1 comprising an amino acid sequence of SEQ ID NO: 6171 (or an amino acid sequence having at least about 77%, 80%, 85%, 90%, 95%, or 99% sequence identity to SEQ ID NO: 6171), and a heavy chain of the first antigen binding domain targeting TRBC1 comprising an amino acid sequence of SEQ ID NO: 6167 (or an amino acid sequence having at least about 77%, 80%, 85%, 90%, 95%, or 99% sequence identity to SEQ ID NO: 6167). In some embodiments, the multifunctional molecule comprises a fusion protein comprising a death receptor signal engager and a light chain of a first antigen binding domain targeting TRBC1 comprising an amino acid sequence of SEQ ID NO: 6171 (or an amino acid sequence having at least about 77%, 80%, 85%, 90%, 95%, or 99% sequence identity to SEQ ID NO: 6171), and a heavy chain of the first antigen binding domain targeting TRBC1 comprising an amino acid sequence of SEQ ID NO: 6168 (or an amino acid sequence having at least about 77%, 80%, 85%, 90%, 95%, or 99% sequence identity to SEQ ID NO: 6168).

In some embodiments, the multifunctional molecule comprises a fusion protein comprising a death receptor signal engager and a light chain of a first antigen binding domain targeting TRBC1 comprising an amino acid sequence of SEQ ID NO: 6172 (or an amino acid sequence having at least about 77%, 80%, 85%, 90%, 95% or 99% sequence identity to SEQ ID NO: 6172), and a heavy chain of the first antigen binding domain targeting TRBC1 comprising an amino acid sequence of SEQ ID NO: 6167 (or an amino acid sequence having at least about 77%, 80%, 85%, 90%, 95%, or 99% sequence identity to SEQ ID NO: 6167). In some embodiments, the multifunctional molecule comprises a fusion protein comprising a death receptor signal engager and a light chain of a first antigen binding domain targeting TRBC1 comprising an amino acid sequence of SEQ ID NO: 6172 (or an amino acid sequence having at least about 77%, 80%, 85%, 90%, 95%, or 99% sequence identity to SEQ ID NO: 6172), and a heavy chain of the first antigen binding domain targeting TRBC1 comprising an amino acid sequence of SEQ ID NO: 6168 (or an amino acid sequence having at least about 77%, 80%, 85%, 90%, 95% or 99% sequence identity to SEQ ID NO: 6168).

TABLE 11

Exemplary death receptor signal engagers

| SEQ ID NO | ID Ref. | Description | Sequence |
| --- | --- | --- | --- |
| SEQ ID NO: 6157 | monomeric_hTRAIL_aa122_281-hFc_Knob_Cys-Blank | Monomeric human TRAIL comprising residues 122-281 | METDTLLLWVLLLWVPGSTGDYKDDDDKGGGGSGT GGAAAHITGTRGRSNTLSSPNSKNEKALGRKINSWESS RSGHSFLSNLHLRNGELVIHEKGFYYIYSQTYFRFQEEI KENTKNDKQMVQYIYKYTSYPDPILLMKSARNSCWSK DAEYGLYSIYQGGIFELKENDRIFVSVTNEHLIDMDHE ASFFGAFAVSGSGNGTSNGTSGSSGGDKTHTCPPCPAP ELLGGPSVFLFPPKPKDTLMISRTPEVTCVVVDVSHED PEVKFNWYVDGVEVHNAKTKPREEQYNSTYRVVSVL TVLHQDWLNGKEYKCKVSNKALPAPIEKTISKAKGQP REPQVYTLPPCREEMTKNQVSLWCLVKGFYPSDIAVE WESNGQPENNYKTTPPVLDSDGSFFLYSKLTVDKSRW QQGNVFSCSVMHEALHNHYTQKSLSLSPGK |
| SEQ ID | dimeric_hTRAIL_aa12 | Dimeric human TRAIL | METDTLLLWVLLLWVPGSTGDYKDDDDKGGGGSGT GGAAAHITGTRGRSNTLSSPNSKNEKALGRKINSWESS |

TABLE 11-continued

Exemplary death receptor signal engagers

| SEQ ID NO: | Ref. | Description | Sequence |
|---|---|---|---|
| SEQ ID NO: 6158 | 2_281-hFc_Knob_Cys-Blank | comprising residues 122-281 | RSGHSFLSNLHLRNGELVIHEKGFYYIYSQTYFRFQEEI KENTKNDKQMVQIYKYTSYPDPILLMKSARNSCWSK DAEYGLYSIYQGGIFELKENDRIFVSVTNEHLIDMDHE ASFFGAFAVSGAAAHITGTRGRSNTLSSPNSKNEKALG RKINSWESSRSGHSFLSNLHLRNGELVIHEKGFYYIYSQ TYFRFQEEIKENTKNDKQMVQIYKYTSYPDPILLMKS ARNSCWSKDAEYGLYSIYQGGIFELKENDRIFVSVTNE HLIDMDHEASFFGAFAVSGSGNGTSNGTSGSSGGDKT HTCPPCPAPELLGGPSVFLFPPKPKDTLMISRTPEVTCV VVDVSHEDPEVKFNWYVDGVEVHNAKTKPREEQYNS TYRVVSVLTVLHQDWLNGKEYKCKVSNKALPAPIEKT ISKAKGQPREPQVYTLPPCREEMTKNQVSLWCLVKGF YPSDIAVEWESNGQPENNYKTTPPVLDSDGSFFLYSKL TVDKSRWQQGNVFSCSVMHEALHNHYTQKSLSLSPG K |
| SEQ ID NO: 6159 | trimeric_hTRAIL_aa 122_281-hFc_Knob_Cys-Blank | Trimeric human TRAIL comprising residues 122-281 | METDTLLLWVLLLWVPGSTGDYKDDDDKGGGGSGT GGAAAHITGTRGRSNTLSSPNSKNEKALGRKINSWESS RSGHSFLSNLHLRNGELVIHEKGFYYIYSQTYFRFQEEI KENTKNDKQMVQIYKYTSYPDPILLMKSARNSCWSK DAEYGLYSIYQGGIFELKENDRIFVSVTNEHLIDMDHE ASFFGAFAVSGAAAHITGTRGRSNTLSSPNSKNEKALG RKINSWESSRSGHSFLSNLHLRNGELVIHEKGFYYIYSQ TYFRFQEEIKENTKNDKQMVQIYKYTSYPDPILLMKS ARNSCWSKDAEYGLYSIYQGGIFELKENDRIFVSVTNE HLIDMDHEASFFGAFAVSGAAAHITGTRGRSNTLSSPN SKNEKALGRKINSWESSRSGHSFLSNLHLRNGELVIHE KGFYYIYSQTYFRFQEEIKENTKNDKQMVQIYKYTS YPDPILLMKSARNSCWSKDAEYGLYSIYQGGIFELKEN DRIFVSVTNEHLIDMDHEASFFGAFAVSGSGNGTSNGT SGSSGGDKTHTCPPCPAPELLGGPSVFLFPPKPKDTLMI SRTPEVTCVVVDVSHEDPEVKFNWYVDGVEVHNAKT KPREEQYNSTYRVVSVLTVLHQDWLNGKEYKCKVSN KALPAPIEKTISKAKGQPREPQVYTLPPCREEMTKNQV SLWCLVKGFYPSDIAVEWESNGQPENNYKTTPPVLDS DGSFFLYSKLTVDKSRWQQGNVFSCSVMHEALHNHY TQKSLSLSPGK |
| SEQ ID NO: 6160 | monomeric_hTRAIL_95-281-hFc_Knob_Cys-Blank | Monomeric human TRAIL comprising residues 95-281 | METDTLLLWVLLLWVPGSTGTSEETISTVQEKQQNISP LVRERGPQRVAAHITGTRGRSNTLSSPNSKNEKALGRK INSWESSRSGHSFLSNLHLRNGELVIHEKGFYYIYSQTY FRFQEEIKENTKNDKQMVQIYKYTSYPDPILLMKSAR NSCWSKDAEYGLYSIYQGGIFELKENDRIFVSVTNEHLI DMDHEASFFGAFLVGGGGSGGGGSDKTHTCPPCPAP ELLGGPSVFLFPPKPKDTLMISRTPEVTCVVVDVSHED PEVKFNWYVDGVEVHNAKTKPREEQYNSTYRVVSVL TVLHQDWLNGKEYKCKVSNKALPAPIEKTISKAKGQP REPQVYTLPPCREEMTKNQVSLWCLVKGFYPSDIAVE WESNGQPENNYKTTPPVLDSDGSFFLYSKLTVDKSRW QQGNVFSCSVMHEALHNHYTQKSLSLSPGK |
| SEQ ID NO: 6161 | dimeric_hTRAIL_95-281-hFc_Knob_Cys-Blank | Dimeric human TRAIL comprising residues 95-281 | METDTLLLWVLLLWVPGSTGTSEETISTVQEKQQNISP LVRERGPQRVAAHITGTRGRSNTLSSPNSKNEKALGRK INSWESSRSGHSFLSNLHLRNGELVIHEKGFYYIYSQTY FRFQEEIKENTKNDKQMVQIYKYTSYPDPILLMKSAR NSCWSKDAEYGLYSIYQGGIFELKENDRIFVSVTNEHLI DMDHEASFFGAFLVGGGGSGGGGSGTSEETISTVQE KQQNISPLVRERGPQRVAAHITGTRGRSNTLSSPNSKN EKALGRKINSWESSRSGHSFLSNLHLRNGELVIHEKGF YYIYSQTYFRFQEEIKENTKNDKQMVQIYKYTSYPDP ILLMKSARNSCWSKDAEYGLYSIYQGGIFELKENDRIF VSVTNEHLIDMDHEASFFGAFLVGGGGSGGGGSDKT HTCPPCPAPELLGGPSVFLFPPKPKDTLMISRTPEVTCV VVDVSHEDPEVKFNWYVDGVEVHNAKTKPREEQYNS TYRVVSVLTVLHQDWLNGKEYKCKVSNKALPAPIEKT ISKAKGQPREPQVYTLPPCREEMTKNQVSLWCLVKGF YPSDIAVEWESNGQPENNYKTTPPVLDSDGSFFLYSKL TVDKSRWQQGNVFSCSVMHEALHNHYTQKSLSLSPG K |
| SEQ ID NO: 6162 | trimeric_hTRAIL_95-281-hFc_Knob_Cys-Blank | Trimeric human TRAIL comprising residues 95-281 | METDTLLLWVLLLWVPGSTGTSEETISTVQEKQQNISP LVRERGPQRVAAHITGTRGRSNTLSSPNSKNEKALGRK INSWESSRSGHSFLSNLHLRNGELVIHEKGFYYIYSQTY FRFQEEIKENTKNDKQMVQIYKYTSYPDPILLMKSAR NSCWSKDAEYGLYSIYQGGIFELKENDRIFVSVTNEHLI |

TABLE 11-continued

Exemplary death receptor signal engagers

| SEQ ID NO ID Ref. | Description | Sequence |
|---|---|---|
| | | DMDHEASFFGAFLVGGGGGSGGGGSGTSEETISTVQE KQQNISPLVRERGPQRVAAHITGTRGRSNTLSSPNSKN EKALGRKINSWESSRSGHSFLSNLHLRNGELVIHEKGF YYIYSQTYFRFQEEIKENTKNDKQMVQYIYKYTSYPDP ILLMKSARNSCWSKDAEYGLYSIYQGGIFELKENDRIF VSVTNEHLIDMDHEASFFGAFLVGGGGGSGGGGSGTS EETISTVQEKQQNISPLVRERGPQRVAAHITGTRGRSNT LSSPNSKNEKALGRKINSWESSRSGHSFLSNLHLRNGE LVIHEKGFYYIYSQTYFRFQEEIKENTKNDKQMVQYIY KYTSYPDPILLMKSARNSCWSKDAEYGLYSIYQGGIFE LKENDRIFVSVTNEHLIDMDHEASFFGAFLVGGGGGSG GGGSDKTHTCPPCPAPELLGGPSVFLFPPKPKDTLMISR TPEVTCVVVDVSHEDPEVKFNWYVDGVEVHNAKTKP REEQYNSTYRVVSVLTVLHQDWLNGKEYKCKVSNKA LPAPIEKTISKAKGQPREPQVYTLPPCREEMTKNQVSL WCLVKGFYPSDIAVEWESNGQPENNYKTTPPVLDSDG SFFLYSKLTVDKSRWQQGNVFSCSVMHEALHNHYTQ KSLSLSPGK |
| SEQ ID NO: 6163 | a_hDR5_Ti gatuzumab_ scFv_VH _VL- hFc_Knob_ Cys-Blank | Antigen binding domain specific to DR5, a.k.a. tigatuzumab | METDTLLLWVLLLWVPGSTGEVQLVESGGGLVQPGG SLRLSCAASGFTFSSYVMSWVRQAPGKGLEWVATISS GGSYTYYPDSVKGRFTISRDNAKNTLYLQMNSLRAED TAVYYCARRGDSMITTDYWGQGTLVTVSSGGGGSGG GGSGGGGSGGGGSDIQMTQSPSSLSASVGDRVTITCKA SQDVGTAVAWYQQKPGKAPKLLIYWASTRHTGVPSR FSGSGSGTDFTLTISSLQPEDFATYYCQQYSSYRTFGQG TKVEIKGGGGSGGGGSDKTHTCPPCPAPELLGGPSVFL FPPKPKDTLMISRTPEVTCVVVDVSHEDPEVKFNWYV DGVEVHNAKTKPREEQYNSTYRVVSVLTVLHQDWLN GKEYKCKVSNKALPAPIEKTISKAKGQPREPQVYTLPP CREEMTKNQVSLWCLVKGFYPSDIAVEWESNGQPEN NYKTTPPVLDSDGSFFLYSKLTVDKSRWQQGNVFSCS VMHEALHNHYTQKSLSLSPGK |
| SEQ ID NO: 6164 | a_hDR5_D rozitumab_ scFv_VH VL- hFc_Knob_ Cys | Antigen binding domain specific to DR5, a.k.a. drozitumab | METDTLLLWVLLLWVPGSTGEVQLVQSGGGVERPGG SLRLSCAASGFTFDDYAMSWVRQAPGKGLEWVSGIN WQGGSTGYADSVKGRVTISRDNAKNSLYLQMNSLRA EDTAVYYCAKILGAGRGWYFDYWGKGTTVTVSSGGG GSGGGGSGGGGSGGGGSSELTQDPAVSVALGQTVRIT CSGDSLRSYYASWYQQKPGQAPVLVIYGANNRPSGIP DRFSGSSSGNTASLTITGAQAEDEADYYCNSADSSGNH VVFGGGTKLTVLGGGGSGGGGSDKTHTCPPCPAPELL GGPSVFLFPPKPKDTLMISRTPEVTCVVVDVSHEDPEV KFNWYVDGVEVHNAKTKPREEQYNSTYRVVSVLTVL HQDWLNGKEYKCKVSNKALPAPIEKTISKAKGQPREP QVYTLPPCREEMTKNQVSLWCLVKGFYPSDIAVEWES NGQPENNYKTTPPVLDSDGSFFLYSKLTVDKSRWQQG NVFSCSVMHEALHNHYTQKSLSLSPGK |
| SEQ ID NO: 6165 | a_hDR5_C onatumuma b_scFv_V H_VL- hFc_Knob_ Cys | Antigen binding domain specific to DR5, a.k.a. conatumumab | METDTLLLWVLLLWVPGSTGQVQLQESGPGLVKPSQT LSLTCTVSGGSISSGDYFWSWIRQLPGKGLEWIGHIHN SGTTYYNPSLKSRVTISVDTSKKQFSLRLSSVTAADTA VYYCARDRGGYDYYYGMDVWGQGTTVTVSSGGGGSG GGGSGGGGSGGGGSEIVLTQSPGTLSLSPGERATLSCR ASQGISRSYLAWYQQKPGQAPSLLIYGASSRATGIPDR FSGSGSGTDFTLTISRLEPEDFAVYYCQQFGSSPWTFGQ GTKVEIKRGGGGSGGGGSDKTHTCPPCPAPELLGGPSV FLFPPKPKDTLMISRTPEVTCVVVDVSHEDPEVKFNWY VDGVEVHNAKTKPREEQYNSTYRVVSVLTVLHQDWL NGKEYKCKVSNKALPAPIEKTISKAKGQPREPQVYTLP PCREEMTKNQVSLWCLVKGFYPSDIAVEWESNGQPEN NYKTTPPVLDSDGSFFLYSKLTVDKSRWQQGNVFSCS VMHEALHNHYTQKSLSLSPGK |
| SEQ ID NO: 6170 | a_hTRBC1 _Jovi1_Hu m1_VL- hCLIg_vk- a_bdr5_Ti gatuzumab _scFv_VH VL | Antigen binding domain specific to DR5, a.k.a. tigatuzumab, with anti-TRBC1 light chain | METDTLLLWVLLLWVPGSTGDVVMTQSPLSLPVTPGE PASISCRSSQRLVHSNGNTYLHWYLQKPGQSPQLLIYR VSNRFPGVPDRFSGSGSGTDFTLKISRVEAEDVGVYFC SQSTHVPYTFGGGTKVEIKRTVAAPSVFIFPPSDEQLKS GTASVVCLLNNFYPREAKVQWKVDNALQSGNSQESV TEQDSKDSTYSLSSTLTLSKADYEKHKVYACEVTHQG LSSPVTKSFNRGECGGGGSGGGGSGGGGSEVQLVESG GGLVQPGGSLRLSCAASGFTFSSYVMSWVRQAPGKGL EWVATISSGGSYTYYPDSVKGRFTISRDNAKNTLYLQ MNSLRAEDTAVYYCARRGDSMITTDYWGQGTLVTVS SGGGGSGGGGSGGGGSGGGGSDIQMTQSPSSLSASVG |

TABLE 11-continued

Exemplary death receptor signal engagers

| SEQ ID NO: | ID Ref. | Description | Sequence |
|---|---|---|---|
| | | | DRVTITCKASQDVGTAVAWYQQKPGKAPKLLIYWAS TRHTGVPSRFSGSGSGTDFTLTISSLQPEDFATYYCQQY SSYRTFGQGTKVEIK |
| SEQ ID NO: 6171 | a_hTRBC1 _Jovi1_Hu m1_VL- hCLIg_vk- a_hDR5_C onatumuma b_scFv_V H_VL | Antigen binding domain specific to DR5, a.k.a. drozitumab, with anti-TRBC1 light chain | METDTLLLWVLLLWVPGSTGDVVMTQSPLSLPVTPGE PASISCRSSQRLVHSNGNTYLHWYLQKPGQSPQLLIYR VSNRFPGVPDRFSGSGSGTDFTLKISRVEAEDVGVYFC SQSTHVPYTFGGGTKVEIKRTVAAPSVFIFPPSDEQLKS GTASVVCLLNNFYPREAKVQWKVDNALQSGNSQESV TEQDSKDSTYSLSSTLTLSKADYEKHKVYACEVTHQG LSSPVTKSFNRGECGGGGSGGGGSGGGGSQVQLQESG PGLVKPSQTLSLTCTVSGGSISSGDYFWSWIRQLPGKG LEWIGHIHNSGTTYYNPSLKSRVTISVDTSKKQFSLRLS SVTAADTAVYYCARDRGGDYYYGMDVWGQGTTVTV SSGGGGSGGGGSGGGGSGGGGSEIVLTQSPGTLSLSPG ERATLSCRASQGISRSYLAWYQQKPGQAPSLLIYGASS RATGIPDRFSGSGSGTDFTLTISRLEPEDFAVYYCQQFG SSPWTFGQGTKVEIKR |
| SEQ ID NO: 6172 | a_hTRBC1 _Jovi1_Hu m1_VL- hCLIg_vk- a_bDR5_D rozitumab_ scFv_VH_ VL | Antigen binding domain specific to DR5, a.k.a. conatumumab, with anti-TRBC1 light chain | METDTLLLWVLLLWVPGSTGDVVMTQSPLSLPVTPGE PASISCRSSQRLVHSNGNTYLHWYLQKPGQSPQLLIYR VSNRFPGVPDRFSGSGSGTDFTLKISRVEAEDVGVYFC SQSTHVPYTFGGGTKVEIKRTVAAPSVFIFPPSDEQLKS GTASVVCLLNNFYPREAKVQWKVDNALQSGNSQESV TEQDSKDSTYSLSSTLTLSKADYEKHKVYACEVTHQG LSSPVTKSFNRGECGGGGSGGGGSGGGGSEVQLVQSG GGVERPGGSLRLSCAASGFTFDDYAMSWVRQAPGKG LEWVSGINWQGGSTGYADSVKGRVTISRDNAKNSLYL QMNSLRAEDTAVYYCAKILGAGRGWYFDYWGKGTT VTVSSGGGGSGGGGSGGGGSGGGGSSELTQDPAVSVA LGQTVRITCSGDSLRSYYASWYQQKPGQAPVLVIYGA NNRPSGIPDRFSGSSSGNTASLTITGAQAEDEADYYCN SADSSGNHVVFGGGTKLTVL |

T Cell Engagers

The present disclosure provides, inter alia, multispecific (e.g., bi-, tri-, quad-specific) or multifunctional molecules, that are engineered to contain one or more T cell engager that mediate binding to and/or activation of a T cell. Accordingly, in some embodiments, the T cell engager is selected from an antigen binding domain or ligand that binds to (e.g., and in some embodiments activates) one or more of CD3, TCRα, TCRβ, TCRγ, TCRζ, ICOS, CD28, CD27, HVEM, LIGHT, CD40, 4-4BB, OX40, DR3, GITR, CD30, TIM1, SLAM, CD2, or CD226. In other embodiments, the T cell engager is selected from an antigen binding domain or ligand that binds to and does not activate one or more of CD3, TCRα, TCRβ, TCRγ, TCRζ, ICOS, CD28, CD27, HVEM, LIGHT, CD40, 4-4BB, OX40, DR3, GITR, CD30, TIM1, SLAM, CD2, or CD226.

TCR Beta V Antigen Binding Domains

In some embodiments, the T cell engager is an antigen binding domain (e.g., an antibody molecule or fragment thereof) that binds to (e.g., and in some embodiments activates) TCRβ. This disclosure provides, inter alia, antibody molecules and fragments thereof, that bind, e.g., specifically bind, to a human TCR beta V chain (TCRβV), e.g., a TCRβV gene family, e.g., a TCRβV subfamily, e.g., as described herein. TCR beta V families and subfamilies are known in the art, e.g., as described in Yassai et al., (2009) *Immunogenetics* 61(7) pp: 493-502; Wei S. and Concannon P. (1994) *Human Immunology* 41(3) pp: 201-206. The antibodies described herein can be recombinant antibodies, e.g., recombinant non-murine antibodies, e.g., recombinant human or humanized antibodies. Throughout this disclosure, TCRβV and TCRBV are used interchangeably.

In some embodiments, the disclosure provides T cell engagers comprising an anti-TCRβV antibody molecule that binds to human TCRβV, e.g., a TCRβV family, e.g., gene family. In some embodiments a TCRBV gene family comprises one or more subfamilies, e.g., as described herein, e.g., in FIG. 6. In some embodiments, the TCRβV gene family comprises subfamilies comprising: a TCRβ V6 subfamily, a TCRβ V10 subfamily, a TCRβ V12 subfamily, a TCRβ V5 subfamily, a TCRβ V7 subfamily, a TCRβ V11 subfamily, a TCRβ V14 subfamily, a TCRβ V16 subfamily, a TCRβ V18 subfamily, a TCRβ V9 subfamily, a TCRβ V13 subfamily, a TCRβ V4 subfamily, a TCRβ V3 subfamily, a TCRβ V2 subfamily, a TCRβ V15 subfamily, a TCRβ V30 subfamily, a TCRβ V19 subfamily, a TCRβ V27 subfamily, a TCRβ V28 subfamily, a TCRβ V24 subfamily, a TCRβ V20 subfamily, TCRβ V25 subfamily, or a TCRβ V29 subfamily.

In some embodiments, TCRβ V6 subfamily is also known as TCRβ V13.1. In some embodiments, the TCRβ V6 subfamily comprises: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments, TCRβ V6 comprises TCRβ V6-5*01. In some embodiments, TCRβ V6, e.g., TCRβ V6-5*01, is recognized, e.g., bound, by SEQ ID NO: 1 and/or SEQ ID NO: 2. In some embodiments, TCRβ V6, e.g., TCRβ V6-5*01, is recognized, e.g., bound, by SEQ ID NO: 9 and/or SEQ ID NO: 10. In some embodiments, TCRβ V6 is recognized, e.g., bound, by SEQ ID NO: 9 and/or SEQ ID NO: 11.

In some embodiments, TCRβ V10 subfamily is also known as TCRβ V12. In some embodiments, the TCRβ V10 subfamily comprises: TCRβ V10-1*01, TCRβ V10-1*02, TCRβ V10-3*01 or TCRβ V10-2*01.

In some embodiments, TCRβ V12 subfamily is also known as TCRβ V8.1. In some embodiments, the TCRβ V12 subfamily comprises: TCRβ V12-4*01, TCRβ V12-3*01, or TCRβ V12-5*01. In some embodiments, TCRβ V12 is recognized, e.g., bound, by SEQ ID NO: 15 and/or SEQ ID NO: 16. In some embodiments, TCRβ V12 is recognized, e.g., bound, by any one of SEQ ID NOs 23-25, and/or any one of SEQ ID NO: 26-30:

In some embodiments, the TCRβ V5 subfamily is chosen from: TCRβ V5-5*01, TCRβ V5-6*01, TCRβ V5-4*01, TCRβ V5-8*01, TCRβ V5-1*01.

In some embodiments, the TCRβ V7 subfamily comprises TCRβ V7-7*01, TCRβ V7-6*01, TCRβ V7-8*02, TCRβ V7-4*01, TCRβ V7-2*02, TCRβ V7-2*03, TCRβ V7-2*01, TCRβ V7-3*01, TCRβ V7-9*03, or TCRβ V7-9*01.

In some embodiments, the TCRβ V11 subfamily comprises: TCRβ V11-1*01, TCRβ V11-2*01 or TCRβ V11-3*01.

In some embodiments, the TCRβ V14 subfamily comprises TCRβ V14*01.

In some embodiments, the TCRβ V16 subfamily comprises TCRβ V16*01.

In some embodiments, the TCRβ V18 subfamily comprises TCRβ V18*01.

In some embodiments, the TCRβ V9 subfamily comprises TCRβ V9*01 or TCRβ V9*02.

In some embodiments, the TCRβ V13 subfamily comprises TCRβ V13*01.

In some embodiments, the TCRβ V4 subfamily comprises TCRβ V4-2*01, TCRβ V4-3*01, or TCRβ V4-1*01.

In some embodiments, the TCRβ V3 subfamily comprises TCRβ V3-1*01.

In some embodiments, the TCRβ V2 subfamily comprises TCRβ V2*01.

In some embodiments, the TCRβ V15 subfamily comprises TCRβ V15*01.

In some embodiments, the TCRβ V30 subfamily comprises TCRβ V30*01, or TCRβ V30*02.

In some embodiments, the TCRβ V19 subfamily comprises TCRβ V19*01, or TCRβ V19*02.

In some embodiments, the TCRβ V27 subfamily comprises TCRβ V27*01.

In some embodiments, the TCRβ V28 subfamily comprises TCRβ V28*01.

In some embodiments, the TCRβ V24 subfamily comprises TCRβ V24-1*01.

In some embodiments, the TCRβ V20 subfamily comprises TCRβ V20-1*01, or TCRβ V20-1*02.

In some embodiments, the TCRβ V25 subfamily comprises TCRβ V25-1*01.

In some embodiments, the TCRβ V29 subfamily comprises TCRβ V29-1*01.

TABLE 12

List of TCRβ V subfamilies and subfamily members

Figure 6:
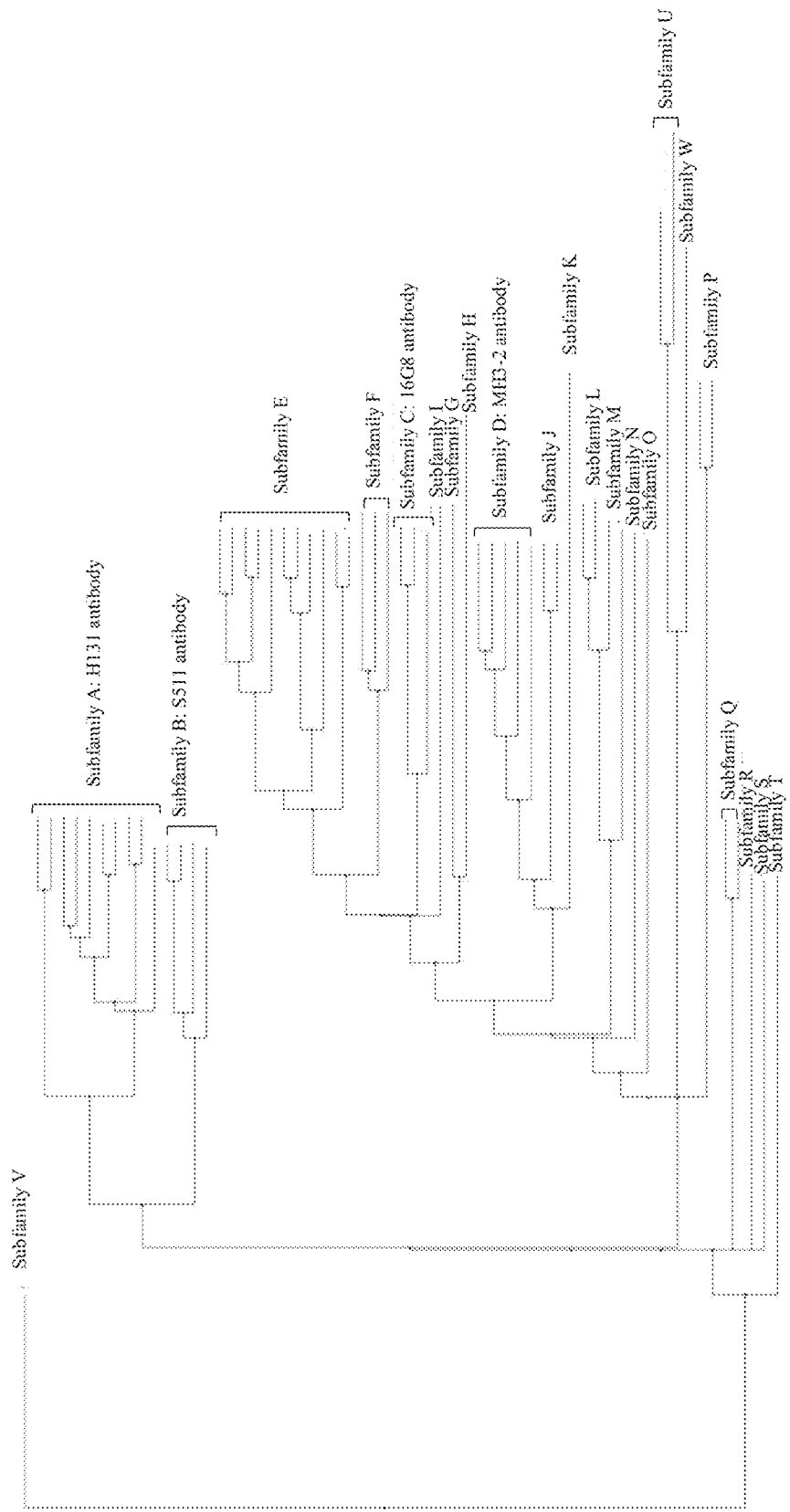
FIG. 6 depicts the phylogenetic tree of TCRBV gene family and subfamilies with corresponding antibodies mapped. Subfamily identities are as follows: Subfamily A: TCRβ V6; Subfamily B: TCRβ V10; Subfamily C: TCRβ V12; Subfamily D: TCRβ V5; Subfamily E: TCRβ V7; Subfamily F: TCRβ V11; Subfamily G: TCRβ V14; Subfamily H: TCRβ V16; Subfamily I: TCRβ V18; Subfamily J: TCRβ V9; Subfamily K: TCRβ V13; Subfamily L: TCRβ V4; Subfamily M: TCRβ V3; Subfamily N: TCRβ V2; Subfamily O: TCRβ V15; Subfamily P: TCRβ V30; Subfamily Q: TCRβ V19; Subfamily R: TCRβ V27; Subfamily S: TCRβ V28; Subfamily T: TCRβ V24; Subfamily U: TCRβ V20; Subfamily V: TCRβ V25; and Subfamily W: TCRβ V29 subfamily. Subfamily members are described in detail herein in the Section titled "TCR beta V (TCRβV)".

| Reference in FIG. 6 | Subfamily | Subfamily members |
|---|---|---|
| A | TCRβ V6 Also referred to as: TCR VB 13.1 | TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. |
| B | TCRβ V10 Also referred to as: TCRβ V12 | TCRβ V10-1*01, TCRβ V10-1*02, TCRβ V10-3*01 or TCRβ V10-2*01 |
| C | TCRβ V12 Also referred to as: TCRβ V8.1 | TCRβ V12-4*01, TCRβ V12-3*01, or TCRβ V12-5*01 |
| D | TCRβ V5 | TCRβ V5-5*01, TCRβ V5-6*01, TCRβ V5-4*01, TCRβ V5-8*01, TCRβ V5-1*01 |
| E | TCRβ V7 | TCRβ V7-7*01, TCRβ V7-6*01, TCRβ V7-8*02, TCRβ V7-4*01, TCRβ V7-2*02, TCRβ V7-2*03, TCRβ V7-2*01, TCRβ V7-3*01, TCRβ V7-9*03, or TCRβ V7-9*01 |
| F | TCRβ V11 | TCRβ V11-1*01, TCRβ V11-2*01 or TCRβ V11-3*01 |
| G | TCRβ V14 | TCRβ V14*01 |
| H | TCRβ V16 | TCRβ V16*01 |
| I | TCRβ V18 | TCRβ V18*01 |
| J | TCRβ V9 | TCRβ V9*01 or TCRβ V9*02 |
| K | TCRβ V13 | TCRβ V13*01 |
| L | TCRβ V4 | TCRβ V4-2*01, TCRβ V4-3*01, or TCRβ V4-1*01 |
| M | TCRβ V3 | TCRβ V3-1*01 |
| N | TCRβ V2 | TCRβ V2*01 |
| O | TCRβ V15 | TCRβ V15*01 |
| P | TCRβ V30 | TCRβ V30*01, or TCRβ V30*02 |
| Q | TCRβ V19 | TCRβ V19*01, or TCRβ V19*02 |
| R | TCRβ V27 | TCRβ V27*01. |
| S | TCRβ V28 | TCRβ V28*01. |
| T | TCRβ V24 | TCRβ V24-1* 01 |
| U | TCRβ V20 | TCRβ V20-1*01, or TCRβ V20-1*02 |
| V | TCRβ V25 | TCRβ V25-1*01 |
| W | TCRβ V29 | TCRβ V29-1*01 |

Anti-TCRβV Antibodies

In an aspect, the disclosure provides an anti-TCRβV antibody molecule that binds to human TCRβV, e.g., a TCRβV gene family, e.g., one or more of a TCRβV subfamily, e.g., as described herein, e.g., in FIG. 6. In some embodiments, the anti-TCRβV antibody molecule binds to one or more TCRβV subfamilies chosen from: a TCRβ V6 subfamily, a TCRβ V10 subfamily, a TCRβ V12 subfamily, a TCRβ V5 subfamily, a TCRβ V7 subfamily, a TCRβ V11 subfamily, a TCRβ V14 subfamily, a TCRβ V16 subfamily, a TCRβ V18 subfamily, a TCRβ V9 subfamily, a TCRβ V13 subfamily, a TCRβ V4 subfamily, a TCRβ V3 subfamily, a TCRβ V2 subfamily, a TCRβ V15 subfamily, a TCRβ V30 subfamily, a TCRβ V19 subfamily, a TCRβ V27 subfamily, a TCRβ V28 subfamily, a TCRβ V24 subfamily, a TCRβ V20 subfamily, TCRβ V25 subfamily, or a TCRβ V29 subfamily. In some embodiments, the anti-TCRβV antibody molecule binds to a TCRβ V6 subfamily comprising: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments the TCRβ V6 subfamily comprises TCRβ V6-5*01. In some embodiments, the anti-TCRβV antibody molecule binds to a TCRβ V10 subfamily comprising: TCRβ V10-1*01, TCRβ V10-1*02, TCRβ V10-3*01 or TCRβ V10-2*01. In some embodiments, the anti-TCRβV antibody molecule binds to a TCRβ V12 subfamily comprising: TCRβ V12-4*01, TCRβ V12-3*01 or TCRβ V12-5*01. In some embodiments, the anti-TCRβV antibody molecule binds to a TCRβ V5 subfamily comprising: TCRβ V5-5*01, TCRβ V5-6*01, TCRβ V5-4*01, TCRβ V5-8*01, TCRβ V5-1*01.

In some embodiments, the anti-TCRβV antibody molecule does not bind to TCRβ V12, or binds to TCRβ V12 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule binds to TCRβ V12 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule binds to a TCRβV region other than TCRβ V12 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the 16G8 murine antibody or a humanized version thereof as described in U.S. Pat. No. 5,861,155.

In some embodiments, the anti-TCRβV antibody molecule does not bind to TCRβ V5-5*01 or TCRβ V5-1*01, or binds to TCRβ V5-5*01 or TCRβ V5-1*01 with an affinity and/or binding specificity that is less than (e.g., less than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments, the anti-TCRβV antibody molecule binds to TCRβ V5-5*01 or TCRβ V5-1*01 with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

In some embodiments, the anti-TCRβV antibody molecule binds to a TCRβV region other than TCRβ V5-5*01 or TCRβ V5-1*01 (e.g., TCRβV region as described herein, e.g., TCRβ V6 subfamily (e.g., TCRβ V6-5*01) with an affinity and/or binding specificity that is greater than (e.g., greater than about 10%, 20%, 30%, 40%, 50%, 60%, 70%, 80%, 90% or about 2-, 5-, or 10-fold) the affinity and/or binding specificity of the TM23 murine antibody or a humanized version thereof as described in U.S. Pat. No. 5,861,155.

Anti-TCRβ V6 Antibodies

Accordingly, in one aspect, the disclosure provides an anti-TCRβV antibody molecule that binds to human TCRβ V6, e.g., a TCRβ V6 subfamily comprising: TCRβ V6-4*01, TCRβ V6-4*02, TCRβ V6-9*01, TCRβ V6-8*01, TCRβ V6-5*01, TCRβ V6-6*02, TCRβ V6-6*01, TCRβ V6-2*01, TCRβ V6-3*01 or TCRβ V6-1*01. In some embodiments the TCRβ V6 subfamily comprises TCRβ V6-5*01.

In some embodiments, TCRβ V6-5*01 is encoded by the nucleic acid sequence of SEQ ID NO: 43, or a sequence having 85%, 90%, 95%, 99% or more identity thereof.

SEQ ID NO: 43
ATGAGCATCGGCCTCCTGTGCTGTGCAGCCTTGTCTCTCCTGTGGGCAGG
TCCAGTGAATGCTGGTGTCACTCAGACCCCAAAATTCCAGGTCCTGAAGA
CAGGACAGAGCATGACACTGCAGTGTGCCCAGGATATGAACCATGAATAC
ATGTCCTGGTATCGACAAGACCCAGGCATGGGGCTGAGGCTGATTCATTA
CTCAGTTGGTGCTGGTATCACTGACCAAGGAGAAGTCCCCAATGGCTACA
ATGTCTCCAGATCAACCACAGAGGATTTCCCGCTCAGGCTGCTGTCGGCT
GCTCCCTCCCAGACATCTGTGTACTTCTGTGCCAGCAGTTACTC

In some embodiments, TCRβ V6-5*01 comprises the amino acid sequence of SEQ ID NO: 44, or an amino acid sequence having 85%, 90%, 95%, 99% or more identity thereof.

SEQ ID NO: 44
MSIGLLCCAALSLLWAGPVNAGVTQTPKFQVLKTGQSMTLQCAQDMNHEY
MSWYRQDPGMGLRLIHYSVGAGITDQGEVPNGYNVSRSTTEDFPLRLLSA
APSQTSVYFCASSY

In some embodiments, the anti-TCRβV antibody molecule, e.g., anti-TCRβ V6 (e.g., anti-TCRβ V6-5*01) antibody molecule, is a non-murine antibody molecule, e.g., a human or humanized antibody molecule. In some embodiments, the anti-TCRβV antibody molecule, e.g., anti-TCRβ V6 (e.g., anti-TCRβ V6-5*01) antibody molecule is a human antibody molecule. In some embodiments, the anti-TCRβV antibody molecule, e.g., anti-TCRβ V6 (e.g., anti-TCRβ V6-5*01) antibody molecule is a humanized antibody molecule.

In some embodiments, the anti-TCRβV antibody molecule, e.g., anti-TCRβ V6 (e.g., anti-TCRβ V6-5*01) antibody molecule, is isolated or recombinant.

In some embodiments, the anti-TCRβV antibody molecule, e.g., anti-TCRβ V6 (e.g., anti-TCRβ V6-5*01) antibody molecule, comprises at least one antigen-binding region, e.g., a variable region or an antigen-binding fragment thereof, from an antibody described herein, e.g., an antibody chosen from BHM1709 or BHM1710, or as described in Table 13, or encoded by the nucleotide sequence in Table 13, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, comprises at least one, two, three or four variable regions from an antibody described herein, e.g., an antibody chosen from BHM1709 or BHM1710, or as described in Table 13, or encoded by the nucleotide sequence in Table 13, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, comprises at least one or two heavy chain variable regions from an antibody described herein, e.g., an antibody chosen from BHM1709 or BHM1710, or as described in Table 13, or encoded by the nucleotide sequence in Table 13, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, comprises at least one or two light chain variable regions from an antibody described herein, e.g., an antibody chosen from BHM1709 or BHM1710, or as described in Table 13, or encoded by the nucleotide sequence in Table 13, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, comprises a heavy chain constant region for an IgG4, e.g., a human IgG4. In still another embodiment, the anti-TCRβV antibody molecule, e.g., anti-TCRβ V6 (e.g., anti-TCRβ V6-5*01) antibody molecule includes a heavy chain constant region for an IgG1, e.g., a human IgG1. In one embodiment, the heavy chain constant region comprises an amino sequence set forth in Table 17, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V6 (e.g., anti-TCRβ V6-5*01) antibody molecule, includes a kappa light chain constant region, e.g., a human kappa light chain constant region. In one embodiment, the light chain constant region comprises an amino sequence set forth in Table 17, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V6 (e.g., anti-TCRβ V6-5*01) antibody molecule, includes at least one, two, or three complementarity determining regions (CDRs) from a heavy chain variable region of an antibody described herein, e.g., an antibody chosen from BHM1709 or BHM1710, or as described in Table 13, or encoded by the nucleotide sequence in Table 13, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, includes at least one, two, or three CDRs (or collectively all of the CDRs) from a heavy chain variable region comprising an amino acid sequence shown in Table 13, or encoded by a nucleotide sequence shown in Table 13. In one embodiment, one or more of the CDRs (or collectively all of the CDRs) have one, two, three, four, five, six or more changes, e.g., amino acid substitutions or deletions, relative to the amino acid sequence shown in Table 13, or encoded by a nucleotide sequence shown in Table 13.

In some embodiments, the anti-TCRβV antibody molecule, e.g., anti-TCRβ V6 (e.g., anti-TCRβ V6-5*01) antibody molecule, includes at least one, two, or three complementarity determining regions (CDRs) from a light chain variable region of an antibody described herein, e.g., an antibody chosen from BHM1709 or BHM1710, or as described in Table 13, or encoded by the nucleotide sequence in Table 13, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V6 (e.g., anti-TCRβ V6-5*01) antibody molecule, includes at least one, two, or three CDRs (or collectively all of the CDRs) from a light chain variable region comprising an amino acid sequence shown in Table 13, or encoded by a nucleotide sequence shown in Table 13. In one embodiment, one or more of the CDRs (or collec-tively all of the CDRs) have one, two, three, four, five, six or more changes, e.g., amino acid substitutions or deletions, relative to the amino acid sequence shown in Table 13, or encoded by a nucleotide sequence shown in Table 13.

In some embodiments, the anti-TCRβV antibody molecule, e.g., anti-TCRβ V6 (e.g., anti-TCRβ V6-5*01) antibody molecule, includes at least one, two, three, four, five or six CDRs (or collectively all of the CDRs) from a heavy and light chain variable region comprising an amino acid sequence shown in Table 13, or encoded by a nucleotide sequence shown in Table 13. In one embodiment, one or more of the CDRs (or collectively all of the CDRs) have one, two, three, four, five, six or more changes, e.g., amino acid substitutions or deletions, relative to the amino acid sequence shown in Table 13, or encoded by a nucleotide sequence shown in Table 13.

In some embodiments, the anti-TCRβV antibody molecule, e.g., anti-TCRβ V6 (e.g., anti-TCRβ V6-5*01) antibody molecule, molecule includes all six CDRs from an antibody described herein, e.g., an antibody chosen from BHM1709 or BHM1710, or as described in Table 13, or encoded by the nucleotide sequence in Table 13, or closely related CDRs, e.g., CDRs which are identical or which have at least one amino acid alteration, but not more than two, three or four alterations (e.g., substitutions, deletions, or insertions, e.g., conservative substitutions). In some embodiments, the anti-TCRβV antibody molecule, e.g., anti-TCRβ V6 (e.g., anti-TCRβ V6-5*01) antibody molecule, may include any CDR described herein.

In some embodiments, the anti-TCRβV antibody molecule, e.g., anti-TCRβ V6 (e.g., anti-TCRβ V6-5*01) antibody molecule includes at least one, two, or three CDRs according to Kabat et al. (e.g., at least one, two, or three CDRs according to the Kabat definition as set out in Table 13) from a heavy chain variable region of an antibody described herein, e.g., an antibody chosen from BHM1709 or BHM1710, or as described in Table 13, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 13.

In some embodiments, the anti-TCRβV antibody molecule, e.g., anti-TCRβ V6 (e.g., anti-TCRβ V6-5*01) antibody molecule includes at least one, two, or three CDRs according to Kabat et al. (e.g., at least one, two, or three CDRs according to the Kabat definition as set out in Table 13) from a light chain variable region of an antibody described herein, e.g., an antibody chosen from BHM1709 or BHM1710, or as described in Table 13, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 13.

In some embodiments, the anti-TCRβV antibody molecule, e.g., anti-TCRβ V6 (e.g., anti-TCRβ V6-5*01) antibody molecule, includes at least one, two, three, four, five, or six CDRs according to Kabat et al. (e.g., at least one, two, three, four, five, or six CDRs according to the Kabat definition as set out in Table 13) from the heavy and light chain variable regions of an antibody described herein, e.g., an antibody chosen from BHM1709 or BHM1710, or as described in Table 13, or encoded by the nucleotide sequence in Table 13; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Kabat et al. shown in Table 13.

In some embodiments, the anti-TCRβV antibody molecule, e.g., anti-TCRβ V6 (e.g., anti-TCRβ V6-5*01) antibody molecule, includes all six CDRs according to Kabat et al. (e.g., all six CDRs according to the Kabat definition as set out in Table 13) from the heavy and light chain variable regions of an antibody described herein, e.g., an antibody chosen from BHM1709 or BHM1710, or as described in Table 13, or encoded by the nucleotide sequence in Table 13; or encoded by the nucleotide sequence in Table 13; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Kabat et al. shown in Table 13. In one embodiment, the anti-TCRβV antibody molecule, e.g., anti-TCRβ V6 (e.g., anti-TCRβ V6-5*01) antibody molecule, may include any CDR described herein.

In some embodiments, the anti-TCRβV antibody molecule, e.g., anti-TCRβ V6 (e.g., anti-TCRβ V6-5*01) antibody molecule, includes at least one, two, or three hypervariable loops that have the same canonical structures as the corresponding hypervariable loop of an antibody described herein, e.g., an antibody chosen from chosen from BHM1709 or BHM1710 e.g., the same canonical structures as at least loop 1 and/or loop 2 of the heavy and/or light chain variable domains of an antibody described herein. See, e.g., Chothia et al., (1992) J. Mol. Biol. 227:799-817; Tomlinson et al., (1992) J. Mol. Biol. 227:776-798 for descriptions of hypervariable loop canonical structures. These structures can be determined by inspection of the tables described in these references.

In some embodiments, the anti-TCRβV antibody molecule, e.g., anti-TCRβ V6 (e.g., anti-TCRβ V6-5*01) antibody molecule includes at least one, two, or three CDRs according to Chothia et al. (e.g., at least one, two, or three CDRs according to the Chothia definition as set out in Table 13) from a heavy chain variable region of an antibody described herein, e.g., an antibody chosen from BHM1709 or BHM1710, or as described in Table 13, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 13.

In some embodiments, the anti-TCRβV antibody molecule, e.g., anti-TCRβ V6 (e.g., anti-TCRβ V6-5*01) antibody molecule includes at least one, two, or three CDRs according to Chothia et al. (e.g., at least one, two, or three CDRs according to the Chothia definition as set out in Table 13) from a light chain variable region of an antibody described herein, e.g., an antibody chosen from BHM1709 or BHM1710, or as described in Table 13, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 13.

In some embodiments, the anti-TCRβV antibody molecule, e.g., anti-TCRβ V6 (e.g., anti-TCRβ V6-5*01) antibody molecule, includes at least one, two, three, four, five, or six CDRs according to Chothia et al. (e.g., at least one, two, three, four, five, or six CDRs according to the Chothia definition as set out in Table 13) from the heavy and light chain variable regions of an antibody described herein, e.g., an antibody chosen from BHM1709 or BHM1710, or as described in Table 13, or encoded by the nucleotide sequence in Table 13; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Chothia et al. shown in Table 13.

In some embodiments, the anti-TCRβV antibody molecule, e.g., anti-TCRβ V6 (e.g., anti-TCRβ V6-5*01) antibody molecule, includes all six CDRs according to Chothia et al. (e.g., all six CDRs according to the Chothia definition as set out in Table 13) from the heavy and light chain variable regions of an antibody described herein, e.g., an antibody chosen from BHM1709 or BHM1710, or as described in Table 13, or encoded by the nucleotide sequence in Table 13; or encoded by the nucleotide sequence in Table 13; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Chothia et al. shown in Table 13. In one embodiment, the anti-TCRβV antibody molecule, e.g., anti-TCRβ V6 (e.g., anti-TCRβ V6-5*01) antibody molecule, may include any CDR described herein.

In some embodiments, the anti-TCRβV antibody molecule, e.g., anti-TCRβ V6 (e.g., anti-TCRβ V6-5*01) antibody molecule, molecule includes a combination of CDRs or hypervariable loops defined according to Kabat et al., Chothia et al., or as described in Table 13.

In some embodiments, the anti-TCRβV antibody molecule, e.g., anti-TCRβ V6 (e.g., anti-TCRβ V6-5*01) antibody molecule, can contain any combination of CDRs or hypervariable loops according to the Kabat and Chothia definitions.

In some embodiments, a combined CDR as set out in Table 13 is a CDR that comprises a Kabat CDR and a Chothia CDR.

In some embodiments, the anti-TCRβV antibody molecule, e.g., anti-TCRβ V6 (e.g., anti-TCRβ V6-5*01) antibody molecule, molecule includes a combination of CDRs or hypervariable loops identified as combined CDRs in Table 13. In some embodiments, the anti-TCRβV antibody molecule, e.g., anti-TCRβ V6 (e.g., anti-TCRβ V6-5*01) antibody molecule, can contain any combination of CDRs or hypervariable loops according the "combined" CDRs are described in Table 13.

In an embodiment, e.g., an embodiment comprising a variable region, a CDR (e.g., a combined CDR, Chothia CDR or Kabat CDR), or other sequence referred to herein, e.g., in Table 13, the antibody molecule is a monospecific antibody molecule, a bispecific antibody molecule, a bivalent antibody molecule, a biparatopic antibody molecule, or an antibody molecule that comprises an antigen binding fragment of an antibody, e.g., a half antibody or antigen binding fragment of a half antibody. In certain embodiments the antibody molecule comprise a multispecific molecule, e.g., a bispecific molecule, e.g., as described herein.

In an embodiment, the anti-TCRβV antibody molecule, e.g., anti-TCRβ V6 (e.g., anti-TCRβ V6-5*01) antibody molecule includes:
(i) one, two or all of a light chain complementarity determining region 1 (LC CDR1), a light chain complementarity determining region 2 (LC CDR2), and a light chain complementarity determining region 3 (LC CDR3) of SEQ ID NO: 2, SEQ ID NO: 10 or SEQ ID NO: 11, and/or
(ii) one, two or all of a heavy chain complementarity determining region 1 (HC CDR1), heavy chain complementarity determining region 2 (HC CDR2), and a heavy chain complementarity determining region 3 (HC CDR3) of SEQ ID NO: 1 or SEQ ID NO: 9.

In some embodiments, the anti-TCRβV antibody molecule, e.g., anti-TCRβ V6 (e.g., anti-TCRβ V6-5*01) antibody molecule comprises a LC CDR1, LC CDR2, and LC CDR3 of SEQ ID NO: 2, and a HC CDR1, HC CDR2, and HC CDR3 of SEQ ID NO: 1.

In some embodiments the anti-TCRβV antibody molecule, e.g., anti-TCRβ V6 (e.g., anti-TCRβ V6-5*01) antibody molecule comprises a LC CDR1, LC CDR2, and LC CDR3 of SEQ ID NO: 10, and a HC CDR1, HC CDR2, and HC CDR3 of SEQ ID NO: 9.

In some embodiments, the anti-TCRβV antibody molecule, e.g., anti-TCRβ V6 (e.g., anti-TCRβ V6-5*01) antibody molecule comprises a LC CDR1, LC CDR2, and LC CDR3 of SEQ ID NO: 11, and a HC CDR1, HC CDR2, and HC CDR3 of SEQ ID NO: 9.

In an embodiment, the anti-TCRβV antibody molecule, e.g., anti-TCRβ V6 (e.g., anti-TCRβ V6-5*01) antibody molecule comprises:
(i) a LC CDR1 amino acid sequence of SEQ ID NO: 6, a LC CDR2 amino acid sequence of SEQ ID NO: 7, or a LC CDR3 amino acid sequence of SEQ ID NO: 8; and/or
(ii) a HC CDR1 amino acid sequence of SEQ ID NO: 3, a HC CDR2 amino acid sequence of SEQ ID NO: 4, or a HC CDR3 amino acid sequence of SEQ ID NO: 5.

In some embodiments, the anti-TCRβV antibody molecule, e.g., anti-TCRβ V6 (e.g., anti-TCRβ V6-5*01) antibody molecule comprises:
(i) a light chain variable region (VL) comprising a LC CDR1 amino acid sequence of SEQ ID NO: 6, a LC CDR2 amino acid sequence of SEQ ID NO: 7, or a LC CDR3 amino acid sequence of SEQ ID NO: 8; and/or
(ii) a heavy chain variable region (VH) comprising a HC CDR1 amino acid sequence of SEQ ID NO: 3, a HC CDR2 amino acid sequence of SEQ ID NO: 4, or a HC CDR3 amino acid sequence of SEQ ID NO: 5.

In an embodiment, the anti-TCRβV antibody molecule, e.g., anti-TCRβ V6 (e.g., anti-TCRβ V6-5*01) antibody molecule comprises:
(i) a LC CDR1 amino acid sequence of SEQ ID NO: 51, a LC CDR2 amino acid sequence of SEQ ID NO: 52, or a LC CDR3 amino acid sequence of SEQ ID NO: 53; and/or
(ii) a HC CDR1 amino acid sequence of SEQ ID NO: 45, a HC CDR2 amino acid sequence of SEQ ID NO: 46, or a HC CDR3 amino acid sequence of SEQ ID NO: 47.

In some embodiments, the anti-TCRβV antibody molecule, e.g., anti-TCRβ V6 (e.g., anti-TCRβ V6-5*01) antibody molecule comprises:
(i) a light chain variable region (VL) comprising a LC CDR1 amino acid sequence of SEQ ID NO: 51, a LC CDR2 amino acid sequence of SEQ ID NO: 52, or a LC CDR3 amino acid sequence of SEQ ID NO: 53; and/or
(ii) a heavy chain variable region (VH) comprising a HC CDR1 amino acid sequence of SEQ ID NO: 45, a HC CDR2 amino acid sequence of SEQ ID NO: 46, or a HC CDR3 amino acid sequence of SEQ ID NO: 47.

In an embodiment, the anti-TCRβV antibody molecule, e.g., anti-TCRβ V6 (e.g., anti-TCRβ V6-5*01) antibody molecule comprises:
(i) a LC CDR1 amino acid sequence of SEQ ID NO: 54, a LC CDR2 amino acid sequence of SEQ ID NO: 55, or a LC CDR3 amino acid sequence of SEQ ID NO: 56; and/or
(ii) a HC CDR1 amino acid sequence of SEQ ID NO: 48, a HC CDR2 amino acid sequence of SEQ ID NO: 49, or a HC CDR3 amino acid sequence of SEQ ID NO: 50.

In some embodiments, the anti-TCRβV antibody molecule, e.g., anti-TCRβ V6 (e.g., anti-TCRβ V6-5*01) antibody molecule comprises:
(i) a light chain variable region (VL) comprising a LC CDR1 amino acid sequence of SEQ ID NO: 54, a LC CDR2 amino acid sequence of SEQ ID NO: 55, or a LC CDR3 amino acid sequence of SEQ ID NO: 56; and/or
(ii) a heavy chain variable region (VH) comprising a HC CDR1 amino acid sequence of SEQ ID NO: 48, a HC CDR2 amino acid sequence of SEQ ID NO: 49, or a HC CDR3 amino acid sequence of SEQ ID NO: 50.

In one embodiment, the light or the heavy chain variable framework (e.g., the region encompassing at least FR1, FR2, FR3, and optionally FR4) of the anti-TCRβV antibody molecule, e.g., anti-TCRβ V6 (e.g., anti-TCRβ V6-5*01) antibody molecule can be chosen from: (a) a light or heavy chain variable framework including at least 80%, 85%, 87% 90%, 92%, 93%, 95%, 97%, 98%, or 100% of the amino acid residues from a human light or heavy chain variable framework, e.g., a light or heavy chain variable framework residue from a human mature antibody, a human germline sequence, or a human consensus sequence; (b) a light or heavy chain variable framework including from 20% to 80%, 40% to 60%, 60% to 90%, or 70% to 95% of the amino acid residues from a human light or heavy chain variable framework, e.g., a light or heavy chain variable framework residue from a human mature antibody, a human germline sequence, or a human consensus sequence; (c) a non-human framework (e.g., a rodent framework); or (d) a non-human framework that has been modified, e.g., to remove antigenic or cytotoxic determinants, e.g., deimmunized, or partially humanized. In one embodiment, the light or heavy chain variable framework region (particularly FR1, FR2 and/or FR3) includes a light or heavy chain variable framework sequence at least 70, 75, 80, 85, 87, 88, 90, 92, 94, 95, 96, 97, 98, 99% identical or identical to the frameworks of a VL or VH segment of a human germline gene.

In some embodiments, the anti-TCRβV antibody molecule, e.g., anti-TCRβ V6 (e.g., anti-TCRβ V6-5*01) antibody molecule, comprises a heavy chain variable domain having at least one, two, three, four, five, six, seven, ten, fifteen, twenty or more changes, e.g., amino acid substitutions or deletions, from an amino acid sequence of BHM1709 or BHM1710.g., the amino acid sequence of the FR region in the entire variable region, e.g., shown in FIG. 4A, or in SEQ ID NO: 9.

Alternatively, or in combination with the heavy chain substitutions described herein, the anti-TCRβV antibody molecule, e.g., anti-TCRβ V6 (e.g., anti-TCRβ V6-5*01) antibody molecule, comprises a light chain variable domain having at least one, two, three, four, five, six, seven, ten, fifteen, twenty or more amino acid changes, e.g., amino acid substitutions or deletions, from an amino acid sequence of BHM1709 or BHM1710. e.g., the amino acid sequence of the FR region in the entire variable region, e.g., shown in FIG. 4B, or in SEQ ID NO: 10 or SEQ ID NO: 11.

In some embodiments, the anti-TCRβV antibody molecule, e.g., anti-TCRβ V6 (e.g., anti-TCRβ V6-5*01) antibody molecule, includes one, two, three, or four heavy chain framework regions shown in FIG. 4A, or a sequence substantially identical thereto.

In some embodiments, the anti-TCRβV antibody molecule, e.g., anti-TCRβ V6 (e.g., anti-TCRβ V6-5*01) antibody molecule, includes one, two, three, or four light chain framework regions shown in FIG. 4B, or a sequence substantially identical thereto.

In some embodiments, the anti-TCRβV antibody molecule, e.g., anti-TCRβ V6 (e.g., anti-TCRβ V6-5*01) antibody molecule, comprises the light chain framework region 1 of BHM1709 or BHM1710, e.g., as shown in FIG. 4B.

In some embodiments, the anti-TCRβV antibody molecule, e.g., anti-TCRβ V6 (e.g., anti-TCRβ V6-5*01) antibody molecule, comprises the light chain framework region 2 of BHM1709 or BHM1710, e.g., as shown in FIG. 4B.

In some embodiments, the anti-TCRβV antibody molecule, e.g., anti-TCRβ V6 (e.g., anti-TCRβ V6-5*01) antibody molecule, comprises the light chain framework region 3 of BHM1709 or BHM1710, e.g., as shown in FIG. 4B.

In some embodiments, the anti-TCRβV antibody molecule, e.g., anti-TCRβ V6 (e.g., anti-TCRβ V6-5*01) antibody molecule, comprises the light chain framework region 4 of BHM1709 or BHM1710, e.g., as shown in FIG. 4B.

In some embodiments, the anti-TCRβV antibody molecule, e.g., anti-TCRβ V6 (e.g., anti-TCRβ V6-5*01) antibody molecule, comprises a light chain variable domain comprising a framework region, e.g., framework region 1 (FR1), comprising a change, e.g., a substitution (e.g., a conservative substitution) at position 10 according to Kabat numbering. In some embodiments, the FR1 comprises a Phenylalanine at position 10, e.g., a Serine to Phenylalanine substitution. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising a framework region, e.g., framework region 2 (FR2), comprising a change, e.g., a substitution (e.g., a conservative substitution) at a position disclosed herein according to Kabat numbering. In some embodiments, FR2 comprises a Histidine at position 36, e.g., a substitution at position 36 according to Kabat numbering, e.g., a Tyrosine to Histidine substitution. In some embodiments, FR2 comprises an Alanine at position 46, e.g., a substitution at position 46 according to Kabat numbering, e.g., a Arginine to Alanine substitution. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising a framework region, e.g., framework region 3 (FR3), comprising a change, e.g., a substitution (e.g., a conservative substitution) at a position disclosed herein according to Kabat numbering. In some embodiments, FR3 comprises a Phenylalanine at position 87, e.g., a substitution at position 87 according to Kabat numbering, e.g., a Tyrosine to Phenylalanine substitution. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising: (a) a framework region 1 (FR1) comprising a Phenylalanine at position 10, e.g., a substitution at position 10 according to Kabat numbering, e.g., a Serine to Phenylalanine substitution; (b) a framework region 2 (FR2) comprising a Histidine at position 36, e.g., a substitution at position 36 according to Kabat numbering, e.g., a Tyrosine to Histidine substitution, and a Alanine at position 46, e.g., a substitution at position 46 according to Kabat numbering, e.g., a Arginine to Alanine substitution; and (c) a framework region 3 (FR3) comprising a Phenylalanine at position 87, e.g., a substitution at position 87 according to Kabat numbering, e.g., a Tyrosine to Phenylalanine substitution, e.g., as shown in the amino acid sequence of SEQ ID NO: 10. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising: (a) a framework region 2 (FR2) comprising a Histidine at position 36, e.g., a substitution at position 36 according to Kabat numbering, e.g., a Tyrosine to Histidine substitution, and a Alanine at position 46, e.g., a substitution at position 46 according to Kabat numbering, e.g., a Arginine to Alanine substitution; and (b) a framework region 3 (FR3) comprising a Phenylalanine at position 87, e.g., a substitution at position 87 according to Kabat numbering, e.g., a Tyrosine to Phenylalanine substitution, e.g., as shown in the amino acid sequence of SEQ ID NO: 11. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises a light chain variable domain comprising: (a) a framework region 1 (FR1) comprising a change, e.g., a substitution (e.g., a conservative substitution) at one or more (e.g., all) positions disclosed herein according to Kabat numbering, (b) a framework region 2 (FR2) comprising a change, e.g., a substitution (e.g., a conservative substitution) at one or more (e.g., all) position disclosed herein according to Kabat numbering and (c) a framework region 3 (FR3) comprising a change, e.g., a substitution (e.g., a conservative substitution) at one or more (e.g., all) position disclosed herein according to Kabat numbering. In some embodiments, the substitution is relative to a human germline light chain framework region sequence.

In some embodiments, the anti-TCRβV antibody molecule, e.g., anti-TCRβ V6 (e.g., anti-TCRβ V6-5*01) antibody molecule, comprises the heavy chain framework region 1 of BHM1709 or BHM1710, e.g., as shown in FIG. 4A.

In some embodiments, the anti-TCRβV antibody molecule, e.g., anti-TCRβ V6 (e.g., anti-TCRβ V6-5*01) antibody molecule, comprises the heavy chain framework region 2 of BHM1709 or BHM1710, e.g., as shown in FIG. 4A.

In some embodiments, the anti-TCRβV antibody molecule, e.g., anti-TCRβ V6 (e.g., anti-TCRβ V6-5*01) antibody molecule, comprises the heavy chain framework region 3 of BHM1709 or BHM1710, e.g., as shown in FIG. 4A.

In some embodiments, the anti-TCRβV antibody molecule, e.g., anti-TCRβ V6 (e.g., anti-TCRβ V6-5*01) antibody molecule, comprises the heavy chain framework region 4 of BHM1709 or BHM1710, e.g., as shown in FIG. 4A.

In some embodiments, the anti-TCRβV antibody molecule, e.g., anti-TCRβ V6 (e.g., anti-TCRβ V6-5*01) antibody molecule, comprises a heavy chain variable domain comprising a framework region, e.g., framework region 3 (FR3), comprising a change, e.g., a substitution (e.g., a conservative substitution) at a position disclosed herein according to Kabat numbering. In some embodiments, FR3 comprises a Threonine at position 73, e.g., a substitution at position 73 according to Kabat numbering, e.g., a Glutamic Acid to Threonine substitution. In some embodiments, FR3 comprises a Glycine at position 94, e.g., a substitution at position 94 according to Kabat numbering, e.g., a Arginine to Glycine substitution. In some embodiments, the substitution is relative to a human germline heavy chain framework region sequence.

In some embodiments, the anti-TCRβV antibody molecule, e.g., anti-TCRβ V6 (e.g., anti-TCRβ V6-5*01) antibody molecule, comprises a heavy chain variable domain comprising a framework region 3 (FR3) comprising a Threonine at position 73, e.g., a substitution at position 73 according to Kabat numbering, e.g., a Glutamic Acid to Threonine substitution, and a Glycine at position 94, e.g., a substitution at position 94 according to Kabat numbering, e.g., a Arginine to Glycine substitution, e.g., as shown in the amino acid sequence of SEQ ID NO: 10.

In some embodiments, the anti-TCRβV antibody molecule, e.g., anti-TCRβ V6 (e.g., anti-TCRβ V6-5*01) antibody molecule, comprises the heavy chain framework regions 1-4 of BHM1709 or BHM1710, e.g., SEQ ID NO: 9, or as shown in FIGS. 4A and 4B.

In some embodiments, the anti-TCRβV antibody molecule, e.g., anti-TCRβ V6 (e.g., anti-TCRβ V6-5*01) antibody molecule, comprises the light chain framework regions 1-4 of BHM1709, e.g., SEQ ID NO: 10, or as shown in FIGS. 4A and 4B.

In some embodiments, the anti-TCRβV antibody molecule, e.g., anti-TCRβ V6 (e.g., anti-TCRβ V6-5*01) antibody molecule, comprises the light chain framework regions 1-4 of BHM1710, e.g., SEQ ID NO: 11, or as shown in FIGS. 4A and 4B.

In some embodiments, the anti-TCRβV antibody molecule, e.g., anti-TCRβ V6 (e.g., anti-TCRβ V6-5*01) antibody molecule, comprises the heavy chain framework regions 1-4 of BHM1709, e.g., SEQ ID NO: 9; and the light chain framework regions 1-4 of BHM1709, e.g., SEQ ID NO: 10, or as shown in FIGS. 4A and 4B.

In some embodiments, the anti-TCRβV antibody molecule, e.g., anti-TCRβ V6 (e.g., anti-TCRβ V6-5*01) antibody molecule, comprises the heavy chain framework regions 1-4 of BHM1710, e.g., SEQ ID NO: 9; and the light chain framework regions 1-4 of BHM1710, e.g., SEQ ID NO: 11, or as shown in FIGS. 4A and 4B.

In some embodiments, the heavy or light chain variable domain, or both, of the anti-TCRβV antibody molecule, e.g., anti-TCRβ V6 (e.g., anti-TCRβ V6-5*01) antibody molecule, includes an amino acid sequence, which is substantially identical to an amino acid disclosed herein, e.g., at least 80%, 85%, 90%, 92%, 95%, 97%, 98%, 99% or higher identical to a variable region of an antibody described herein, e.g., an antibody chosen from BHM1709 or BHM1710, or as described in Table 13, or encoded by the nucleotide sequence in Table 13; or which differs at least 1 or 5 residues, but less than 40, 30, 20, or 10 residues, from a variable region of an antibody described herein.

In some embodiments, the anti-TCRβV antibody molecule, e.g., anti-TCRβ V6 (e.g., anti-TCRβ V6-5*01) antibody molecule, comprises at least one, two, three, or four antigen-binding regions, e.g., variable regions, having an amino acid sequence as set forth in Table 13, or a sequence substantially identical thereto (e.g., a sequence at least about 85%, 90%, 95%, 99% or more identical thereto, or which differs by no more than 1, 2, 5, 10, or 15 amino acid residues from the sequences shown in Table 13. In another embodiment, the anti-TCRβV antibody molecule, e.g., anti-TCRβ V6 (e.g., anti-TCRβ V6-5*01) antibody molecule includes a VH and/or VL domain encoded by a nucleic acid having a nucleotide sequence as set forth in Table 13, or a sequence substantially identical thereto (e.g., a sequence at least about 85%, 90%, 95%, 99% or more identical thereto, or which differs by no more than 3, 6, 15, 30, or 45 nucleotides from the sequences shown in Table 13.

In some embodiments, the anti-TCRβV antibody molecule, e.g., anti-TCRβ V6 (e.g., anti-TCRβ V6-5*01) antibody molecule, comprises:
  a VH domain comprising the amino acid sequence of SEQ ID NO: 9, an amino acid sequence at least about 85%, 90%, 95%, 99% or more identical to the amino acid sequence of SEQ ID NO: 9, or an amino acid sequence which differs by no more than 1, 2, 5, 10, or 15 amino acid residues from the amino acid sequence of SEQ ID NO: 9; and/or
  a VL domain comprising the amino acid sequence of SEQ ID NO: 10, an amino acid sequence at least about 85%, 90%, 95%, 99% or more identical to the amino acid sequence of SEQ ID NO: 10, or an amino acid sequence which differs by no more than 1, 2, 5, 10, or 15 amino acid residues from the amino acid sequence of SEQ ID NO: 10.

In some embodiments, the anti-TCRβV antibody molecule, e.g., anti-TCRβ V6 (e.g., anti-TCRβ V6-5*01) antibody molecule, comprises:
  a VH domain comprising the amino acid sequence of SEQ ID NO: 9, an amino acid sequence at least about 85%, 90%, 95%, 99% or more identical to the amino acid sequence of SEQ ID NO: 9, or an amino acid sequence which differs by no more than 1, 2, 5, 10, or 15 amino acid residues from the amino acid sequence of SEQ ID NO: 9; and/or
  a VL domain comprising the amino acid sequence of SEQ ID NO: 11, an amino acid sequence at least about 85%, 90%, 95%, 99% or more identical to the amino acid sequence of SEQ ID NO: 11, or an amino acid sequence which differs by no more than 1, 2, 5, 10, or 15 amino acid residues from the amino acid sequence of SEQ ID NO: 11.

In some embodiments, the anti-TCRβV antibody molecule, e.g., anti-TCRβ V6 (e.g., anti-TCRβ V6-5*01) antibody molecule is a full antibody or fragment thereof (e.g., a Fab, F(ab')₂, Fv, or a single chain Fv fragment (scFv)). In embodiments, the anti-TCRβV antibody molecule, e.g., anti-TCRβ V6 (e.g., anti-TCRβ V6-5*01) antibody molecule is a monoclonal antibody or an antibody with single specificity. In some embodiments, the anti-TCRβV antibody molecule, e.g., anti-TCRβ V6 (e.g., anti-TCRβ V6-5*01) antibody molecule, can also be a humanized, chimeric, camelid, shark, or an in vitro-generated antibody molecule. In some embodiments, the anti-TCRβV antibody molecule, e.g., anti-TCRβ V6 (e.g., anti-TCRβ V6-5*01) antibody molecule, is a humanized antibody molecule. The heavy and light chains of the anti-TCRβV antibody molecule, e.g., anti-TCRβ V6 (e.g., anti-TCRβ V6-5*01) antibody molecule, can be full-length (e.g., an antibody can include at least one, and preferably two, complete heavy chains, and at least one, and preferably two, complete light chains) or can include an antigen-binding fragment (e.g., a Fab, F(ab')2, Fv, a single chain Fv fragment, a single domain antibody, a diabody (dAb), a bivalent antibody, or bispecific antibody or fragment thereof, a single domain variant thereof, or a camelid antibody).

In some embodiments, the anti-TCRβV antibody molecule, e.g., anti-TCRβ V6 (e.g., anti-TCRβ V6-5*01) antibody molecule, is in the form of a multispecific molecule, e.g., a bispecific molecule, e.g., as described herein.

In some embodiments, the anti-TCRβV antibody molecule, e.g., anti-TCRβ V6 (e.g., anti-TCRβ V6-5*01) antibody molecule, has a heavy chain constant region (Fc) chosen from, e.g., the heavy chain constant regions of IgG1, IgG2, IgG3, IgG4, IgM, IgA1, IgA2, IgD, and IgE. In some embodiments, the Fc region is chosen from the heavy chain constant regions of IgG1, IgG2, IgG3, and IgG4. In some embodiments, the Fc region is chosen from the heavy chain constant region of IgG1 or IgG2 (e.g., human IgG1, or IgG2). In some embodiments, the heavy chain constant region is human IgG1.

In some embodiments, the anti-TCRβV antibody molecule, e.g., anti-TCRβ V6 (e.g., anti-TCRβ V6-5*01) antibody molecule, has a light chain constant region chosen from, e.g., the light chain constant regions of kappa or lambda, preferably kappa (e.g., human kappa). In one embodiment, the constant region is altered, e.g., mutated, to modify the properties of the anti-TCRβV antibody molecule, e.g., anti-TCRβ V6 (e.g., anti-TCRβ V6-5*01) antibody molecule (e.g., to increase or decrease one or more of: Fc receptor binding, antibody glycosylation, the number of cysteine residues, effector cell function, or complement function). For example, the constant region is mutated at positions 296 (M to Y), 298 (S to T), 300 (T to E), 477 (H to K) and 478 (N to F) to alter Fc receptor binding (e.g., the mutated positions correspond to positions 132 (M to Y), 134 (S to T), 136 (T to E), 313 (H to K) and 314 (N to F) of SEQ ID NOs: 212 or 214; or positions 135 (M to Y), 137 (S to T), 139 (T to E), 316 (H to K) and 317 (N to F) of SEQ ID NOs: 215, 216, 217 or 218), e.g., relative to human IgG1.

TABLE 13

Amino acid and nucleotide sequences for murine, chimeric and humanized antibody molecules. The antibody molecules include murine mAb H131, and humanized mAb H131 Clones BHM1709 and BHM1710. The amino acid the heavy and light chain CDRs, and the amino acid and nucleotide sequences of the heavy and light chain variable regions, and the heavy and light chains are shown.

H131 (murine)

| SEQ ID NO: | | | |
|---|---|---|---|
| SEQ ID NO: 3 | HC CDR1 | (Combined) | GYSFTTYYIH |
| SEQ ID NO: 4 | HC CDR2 | (Combined) | WFFPGSGNIKYNEKFKG |
| SEQ ID NO: 5 | HC CDR3 | (Combined) | SYYSYDVLDY |
| SEQ ID NO: 45 | HC CDR1 | (Kabat) | TYYIH |
| SEQ ID NO: 46 | HC CDR2 | (Kabat) | WFFPGSGNIKYNEKFKG |
| SEQ ID NO: 47 | HC CDR3 | (Kabat) | SYYSYDVLDY |
| SEQ ID NO: 48 | HC CDR1 | (Chothia) | GYSFTTY |
| SEQ ID NO: 49 | HC CDR2 | (Chothia) | FPGSGN |
| SEQ ID NO: 50 | HC CDR3 | (Chothia) | SYYSYDVLDY |
| SEQ ID NO: 1 | VH | | QVQLQQSGPELVKPGTSVKISCKASGYSFTTYYIHW VKQRPGQGLEWIGWFFPGSGNIKYNEKFKGKATLT ADTSSSTAYMQLSSLTSEESAVYFCAGSYYSYDVLD YWGHGTTLTVSS |
| SEQ ID NO: 6 | LC CDR1 | (Combined) | KASQNVGINVV |
| SEQ ID NO: 7 | LC CDR2 | (Combined)) | SSSHRYS |
| SEQ ID NO: 8 | LC CDR3 | (Combined) | QQFKSYPLT |
| SEQ ID NO: 51 | LC CDR1 | (Kabat) | KASQNVGINVV |
| SEQ ID NO: 52 | LC CDR2 | (Kabat) | SSSHRYS |
| SEQ ID NO: 53 | LC CDR3 | (Kabat) | QQFKSYPLT |
| SEQ ID NO: 54 | LC CDR1 | (Chothia) | KASQNVGINVV |
| SEQ ID NO: 55 | LC CDR2 | (Chothia) | SSSHRYS |
| SEQ ID NO: 56 | LC CDR3 | (Chothia) | QQFKSYPLT |
| SEQ ID NO: 2 | VL | | DILMTQSQKFMSTSLGDRVSVSCKASQNVGINVVW HQQKPGQSPKALIYSSSHRYSGVPDRFTGSGSGTDF TLTINNVQSEDLAEYFCQQFKSYPLTFGAGTKLELK |

BHM1709 (humanized)

| SEQ ID NO: 3 | HC CDR1 | (Combined) | GYSFTTYYIH |
|---|---|---|---|
| SEQ ID NO: 4 | HC CDR2 | (Combined) | WFFPGSGNIKYNEKFKG |
| SEQ ID NO: 5 | HC CDR3 | (Combined) | SYYSYDVLDY |
| SEQ ID NO: 9 | VH | | QVQLVQSGAEVKKPGSSVKVSCKASGYSFTTYYIH WVRQAPGQGLEWMGWFFPGSGNIKYNEKFKGRVT ITADTSTSTAYMELSSLRSEDTAVYYCAGSYYSYDV LDYWGQGTTVTVSS |
| SEQ ID NO: 12 | DNA VH | | CAGGTGCAGCTGGTTCAGTCTGGCGCCGAAGTGA AGAAACCTGGCTCCTCCGTGAAGGTGTCCTGCAA GGCTTCCGGCTACTCCTTCACCACCTACTACATCC ACTGGGTCCGACAGGCCCCTGGACAAGGATTGGA |

TABLE 13-continued

Amino acid and nucleotide sequences for murine, chimeric and humanized antibody molecules. The antibody molecules include murine mAb H131, and humanized mAb H131 Clones BHM1709 and BHM1710. The amino acid the heavy and light chain CDRs, and the amino acid and nucleotide sequences of the heavy and light chain variable regions, and the heavy and light chains are shown.

| | | |
|---|---|---|
| | | ATGGATGGGCTGGTTCTTCCCCGGCTCCGGCAAC ATCAAGTACAACGAGAAGTTCAAGGGCCGCGTGA CCATCACCGCCGACACCTCTACCTCTACCGCCTAC ATGGAACTGTCCAGCCTGAGATCTGAGGACACCG CCGTGTACTACTGCGCCGGCTCCTACTACTCTTAC GACGTGCTGGATTACTGGGGCCAGGGCACCACAG TGACAGTGTCCTCT |
| SEQ ID NO: 6 | LC CDR1 (Combined) | KASQNVGINVV |
| SEQ ID NO: 7 | LC CDR2 (Combined)) | SSSHRYS |
| SEQ ID NO: 8 | LC CDR3 (Combined) | QQFKSYPLT |
| SEQ ID NO: 10 | VL | IQMTQSPSFLSASVGDRVTITCKASQNVGINVVWHQ QKPGKAPKALIYSSSHRYSGVPSRFSGSGSGTEFTLT ISSLQPEDFATYFCQQFKSYPLTFGQGTKLEIK |
| SEQ ID NO: 13 | DNA VL | GACATCCAGATGACCCAGTCTCCATCCTTCCTGTC CGCCTCTGTGGGCGACAGAGTGACCATCACATGC AAGGCCTCTCAGAACGTGGGCATCAACGTCGTGT GGCACCAGCAGAAGCCTGGCAAGGCTCCTAAGGC TCTGATCTACTCCTCCAGCCACCGGTACTCTGGCG TGCCCTCTAGATTTTCCGGCTCTGGCTCTGGCACC GAGTTTACCCTGACAATCTCCAGCCTGCAGCCTG AGGACTTCGCCACCTACTTTTGCCAGCAGTTCAA GAGCTACCCTCTGACCTTTGGCCAGGGCACCAAG CTGGAAATCAAG |

BHM1710 (humanized)

| | | |
|---|---|---|
| SEQ ID NO: 3 | HC CDR1 (Combined) | GYSFTTYYIH |
| SEQ ID NO: 4 | HC CDR2 (Combined) | WFFPGSGNIKYNEKFKG |
| SEQ ID NO: 5 | HC CDR3 (Combined) | SYYSYDVLDY |
| SEQ ID NO: 9 | VH | QVQLVQSGAEVKKPGSSVKVSCKASGYSFTTYYIH WVRQAPGQGLEWMGWFFPGSGNIKYNEKFKGRVT ITADTSTSTAYMELSSLRSEDTAVYYCAGSYYSYDV LDYWGQGTTVTVSS |
| SEQ ID NO: 12 | DNA VH | CAGGTGCAGCTGGTTCAGTCTGGCGCCGAAGTGA AGAAACCTGGCTCCTCCGTGAAGGTGTCCTGCAA GGCTTCCGGCTACTCCTTCACCACCTACTACATCC ACTGGGTCCGACAGGCCCCTGGACAAGGATTGGA ATGGATGGGCTGGTTCTTCCCCGGCTCCGGCAAC ATCAAGTACAACGAGAAGTTCAAGGGCCGCGTGA CCATCACCGCCGACACCTCTACCTCTACCGCCTAC ATGGAACTGTCCAGCCTGAGATCTGAGGACACCG CCGTGTACTACTGCGCCGGCTCCTACTACTCTTAC GACGTGCTGGATTACTGGGGCCAGGGCACCACAG TGACAGTGTCCTCT |
| SEQ ID NO: 6 | LC CDR1 (Combined) | KASQNVGINVV |
| SEQ ID NO: 7 | LC CDR2 (Combined)) | SSSHRYS |
| SEQ ID NO: 8 | LC CDR3 (Combined) | QQFKSYPLT |
| SEQ ID NO: 11 | VL | DIQMTQSPSSLSASVGDRVTITCKASQNVGINVVWH QQKPGKVPKALIYSSSHRYSGVPSRFSGSGSGTDFTL TISSLQPEDVATYFCQQFKSYPLTFGQGTKLEIK |
| SEQ ID NO: 14 | DNA VL | GACATCCAGATGACCCAGTCTCCATCCTCTCTGTC CGCCTCTGTGGGCGACAGAGTGACCATCACATGC AAGGCCTCTCAGAACGTGGGCATCAACGTCGTGT GGCACCAGCAGAAACCTGGCAAGGTGCCCAAGG CTCTGATCTACTCCTCCAGCCACAGATACTCCGGC GTGCCCTCTAGATTCTCCGGCTCTGGCTCTGGCAC CGACTTTACCCTGACAATCTCCAGCCTGCAGCCTG AGGACGTGGCCACCTACTTTTGCCAGCAGTTCAA GAGCTACCCTCTGACCTTTGGCCAGGGCACCAAG CTGGAAATCAAG |

Anti-TCRβ V12 Antibodies

Accordingly, in one aspect, the disclosure provides an anti-TCRβV antibody molecule that binds to human TCRβ V12, e.g., a TCRβ V12 subfamily comprising: TCRβ V12-4*01, TCRβ V12-3*01 or TCRβ V12-5*01. In some embodiments the TCRβ V12 subfamily comprises TCRβ V12-4*01. In some embodiments the TCRβ V12 subfamily comprises TCRβ V12-3*01.

In some embodiments, the anti-TCRβV antibody molecule, e.g., anti-TCRβ V12 antibody molecule, is a non-murine antibody molecule, e.g., a human or humanized antibody molecule. In some embodiments, the anti-TCRβV antibody molecule, e.g., anti-TCRβ V12 antibody molecule is a human antibody molecule. In some embodiments, the anti-TCRβV antibody molecule, e.g., anti-TCRβ V12 antibody molecule is a humanized antibody molecule.

In some embodiments, the anti-TCRβV antibody molecule, e.g., anti-TCRβ V12 antibody molecule, is isolated or recombinant.

In some embodiments, the anti-TCRβV antibody molecule, e.g., anti-TCRβ V12 antibody molecule, comprises at least one antigen-binding region, e.g., a variable region or an antigen-binding fragment thereof, from an antibody described herein, e.g., an antibody described in Table 14, or encoded by the nucleotide sequence in Table 14, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises at least one, two, three or four variable regions from an antibody described herein, e.g., an antibody as described in Table 14, or encoded by the nucleotide sequence in Table 14, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises at least one or two heavy chain variable regions from an antibody described herein, e.g., an antibody as described in Table 14, or encoded by the nucleotide sequence in Table 14, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises at least one or two light chain variable regions from an antibody described herein, e.g., an antibody as described in Table 14, or encoded by the nucleotide sequence in Table 14, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, comprises a heavy chain constant region for an IgG4, e.g., a human IgG4. In still another embodiment, the anti-TCRβV antibody molecule, e.g., anti-TCRβ V12 antibody molecule, includes a heavy chain constant region for an IgG1, e.g., a human IgG1. In one embodiment, the heavy chain constant region comprises an amino sequence set forth in Table 17, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V12 antibody molecule, includes a kappa light chain constant region, e.g., a human kappa light chain constant region. In one embodiment, the light chain constant region comprises an amino sequence set forth in Table 17, or a sequence substantially identical (e.g., at least 80%, 85%, 90%, 92%, 95%, 97%, 98%, 99% or higher identical) thereto.

In some embodiments, the anti-TCRβV antibody molecule, e.g., anti-TCRβ V12 antibody molecule, includes at least one, two, or three complementarity determining regions (CDRs) from a heavy chain variable region of an antibody described herein, e.g., an antibody as described in Table 14, or encoded by the nucleotide sequence in Table 14, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, includes at least one, two, or three CDRs (or collectively all of the CDRs) from a heavy chain variable region comprising an amino acid sequence shown in Table 14, or encoded by a nucleotide sequence shown in Table 14. In one embodiment, one or more of the CDRs (or collectively all of the CDRs) have one, two, three, four, five, six or more changes, e.g., amino acid substitutions or deletions, relative to the amino acid sequence shown in Table 14, or encoded by a nucleotide sequence shown in Table 14.

In some embodiments, the anti-TCRβV antibody molecule, e.g., anti-TCRβ V12 antibody molecule, includes at least one, two, or three complementarity determining regions (CDRs) from a light chain variable region of an antibody described herein, e.g., an antibody as described in Table 14, or encoded by the nucleotide sequence in Table 14, or a sequence substantially identical (e.g., at least 80%, 85%, 90%, 92%, 95%, 97%, 98%, 99% or higher identical) to any of the aforesaid sequences.

In some embodiments, the anti-TCRβV antibody molecule, e.g., anti-TCRβ V12 antibody molecule, includes at least one, two, or three CDRs (or collectively all of the CDRs) from a light chain variable region comprising an amino acid sequence shown in Table 14, or encoded by a nucleotide sequence shown in Table 14. In one embodiment, one or more of the CDRs (or collectively all of the CDRs) have one, two, three, four, five, six or more changes, e.g., amino acid substitutions or deletions, relative to the amino acid sequence shown in Table 14, or encoded by a nucleotide sequence shown in Table 14.

In some embodiments, the anti-TCRβV antibody molecule, e.g., anti-TCRβ V12 antibody molecule, includes at least one, two, three, four, five or six CDRs (or collectively all of the CDRs) from a heavy and light chain variable region comprising an amino acid sequence shown in Table 14, or encoded by a nucleotide sequence shown in Table 14. In one embodiment, one or more of the CDRs (or collectively all of the CDRs) have one, two, three, four, five, six or more changes, e.g., amino acid substitutions or deletions, relative to the amino acid sequence shown in Table 14, or encoded by a nucleotide sequence shown in Table 14.

In some embodiments, the anti-TCRβV antibody molecule, e.g., anti-TCRβ V12 antibody molecule, molecule includes all six CDRs from an antibody described herein, e.g., an antibody as described in Table 14, or encoded by the nucleotide sequence in Table 14, or closely related CDRs, e.g., CDRs which are identical or which have at least one amino acid alteration, but not more than two, three or four alterations (e.g., substitutions, deletions, or insertions, e.g., conservative substitutions). In some embodiments, the anti-TCRβV antibody molecule, e.g., anti-TCRβ V12 antibody molecule, may include any CDR described herein.

In some embodiments, the anti-TCRβV antibody molecule, e.g., anti-TCRβ V12 antibody molecule includes at least one, two, or three CDRs according to Kabat et al. (e.g., at least one, two, or three CDRs according to the Kabat definition as set out in Table 14) from a heavy chain variable region of an antibody described herein, e.g., an antibody chosen as described in Table 14, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 14.

In some embodiments, the anti-TCRβV antibody molecule, e.g., anti-TCRβ V12 antibody molecule includes at least one, two, or three CDRs according to Kabat et al. (e.g., at least one, two, or three CDRs according to the Kabat definition as set out in Table 14) from a light chain variable region of an antibody described herein, e.g., an antibody as described in Table 14, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Kabat et al. shown in Table 14.

In some embodiments, the anti-TCRβV antibody molecule, e.g., anti-TCRβ V12 antibody molecule includes at least one, two, three, four, five, or six CDRs according to Kabat et al. (e.g., at least one, two, three, four, five, or six CDRs according to the Kabat definition as set out in Table 14) from the heavy and light chain variable regions of an antibody described herein, e.g., an antibody as described in Table 14, or encoded by the nucleotide sequence in Table 14; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Kabat et al. shown in Table 14.

In some embodiments, the anti-TCRβV antibody molecule, e.g., anti-TCRβ V12 antibody molecule includes all six CDRs according to Kabat et al. (e.g., all six CDRs according to the Kabat definition as set out in Table 14) from the heavy and light chain variable regions of an antibody described herein, e.g., an antibody as described in Table 14, or encoded by the nucleotide sequence in Table 14; or encoded by the nucleotide sequence in Table 14; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Kabat et al. shown in Table 14. In some embodiments, the anti-TCRβV antibody molecule, e.g., anti-TCRβ V12 antibody molecule may include any CDR described herein.

In some embodiments, the anti-TCRβV antibody molecule, e.g., anti-TCRβ V12 antibody molecule includes at least one, two, or three hypervariable loops that have the same canonical structures as the corresponding hypervariable loop of an antibody described herein, e.g., an antibody described in Table 14, e.g., the same canonical structures as at least loop 1 and/or loop 2 of the heavy and/or light chain variable domains of an antibody described herein. See, e.g., Chothia et al., (1992) J. Mol. Biol. 227:799-817; Tomlinson et al., (1992) J. Mol. Biol. 227:776-798 for descriptions of hypervariable loop canonical structures. These structures can be determined by inspection of the tables described in these references.

In some embodiments, the anti-TCRβV antibody molecule, e.g., anti-TCRβ V12 antibody molecule includes at least one, two, or three CDRs according to Chothia et al. (e.g., at least one, two, or three CDRs according to the Chothia definition as set out in Table 14) from a heavy chain variable region of an antibody described herein, e.g., an antibody chosen as described in Table 14, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 14.

In some embodiments, the anti-TCRβV antibody molecule, e.g., anti-TCRβ V12 antibody molecule includes at least one, two, or three CDRs according to Chothia et al. (e.g., at least one, two, or three CDRs according to the Chothia definition as set out in Table 14) from a light chain variable region of an antibody described herein, e.g., an antibody as described in Table 14, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to Chothia et al. shown in Table 14.

In some embodiments, the anti-TCRβV antibody molecule, e.g., anti-TCRβ V12 antibody molecule includes at least one, two, three, four, five, or six CDRs according to Chothia et al. (e.g., at least one, two, three, four, five, or six CDRs according to the Chothia definition as set out in Table 14) from the heavy and light chain variable regions of an antibody described herein, e.g., an antibody as described in Table 14, or encoded by the nucleotide sequence in Table 14; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to Chothia et al. shown in Table 14.

In some embodiments, the anti-TCRβV antibody molecule, e.g., anti-TCRβ V12 antibody molecule includes all six CDRs according to Chothia et al. (e.g., all six CDRs according to the Chothia definition as set out in Table 14) from the heavy and light chain variable regions of an antibody described herein, e.g., an antibody as described in Table 14, or encoded by the nucleotide sequence in Table 14; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to Chothia et al. shown in Table 14. In some embodiments, the anti-TCRβV antibody molecule, e.g., anti-TCRβ V12 antibody molecule may include any CDR described herein.

In some embodiments, the anti-TCRβV antibody molecule, e.g., anti-TCRβ V12 antibody molecule includes at least one, two, or three CDRs according to a combined CDR (e.g., at least one, two, or three CDRs according to the combined CDR definition as set out in Table 14) from a heavy chain variable region of an antibody described herein, e.g., an antibody chosen as described in Table 14, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to combined CDR shown in Table 14.

In some embodiments, the anti-TCRβV antibody molecule, e.g., anti-TCRβ V12 antibody molecule includes at least one, two, or three CDRs according to a combined CDR (e.g., at least one, two, or three CDRs according to the combined CDR definition as set out in Table 14) from a light chain variable region of an antibody described herein, e.g., an antibody as described in Table 14, or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, or three CDRs according to a combined CDR shown in Table 14.

In some embodiments, the anti-TCRβV antibody molecule, e.g., anti-TCRβ V12 antibody molecule includes at least one, two, three, four, five, or six CDRs according to a combined CDR. (e.g., at least one, two, three, four, five, or six CDRs according to the combined CDR definition as set out in Table 14) from the heavy and light chain variable regions of an antibody described herein, e.g., an antibody as described in Table 14, or encoded by the nucleotide sequence in Table 14; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to one, two, three, four, five, or six CDRs according to a combined CDR shown in Table 14.

In some embodiments, the anti-TCRβV antibody molecule, e.g., anti-TCRβ V12 antibody molecule includes all six CDRs according to a combined CDR (e.g., all six CDRs according to the combined CDR definition as set out in Table 14) from the heavy and light chain variable regions of an antibody described herein, e.g., an antibody as described in Table 14, or encoded by the nucleotide sequence in Table 14; or encoded by the nucleotide sequence in Table 14; or a sequence substantially identical (e.g., at least 80%, 85%, 90%, 92%, 95%, 97%, 98%, 99% or higher identical) to any of the aforesaid sequences; or which have at least one amino acid alteration, but not more than two, three or four alterations (e.g., substitutions, deletions, or insertions, e.g., conservative substitutions) relative to all six CDRs according to a combined CDR shown in Table 14. In some embodiments, the anti-TCRβV antibody molecule, e.g., anti-TCRβ V12 antibody molecule may include any CDR described herein.

In some embodiments, a combined CDR as set out in Table 13 is a CDR that comprises a Kabat CDR and a Chothia CDR.

In some embodiments, the anti-TCRβV antibody molecule, e e.g., anti-TCRβ V12 antibody molecule, molecule includes a combination of CDRs or hypervariable loops identified as combined CDRs in Table 13. In some embodiments, the anti-TCRβV antibody molecule, e.g., anti-TCRβ V12 antibody molecule, can contain any combination of CDRs or hypervariable loops according the "combined" CDRs are described in Table 13.

In some embodiments, the anti-TCRβV antibody molecule, e.g., anti-TCRβ V12 antibody molecule includes a combination of CDRs or hypervariable loops defined according to the Kabat et al. and Chothia et al., or as described in Table 13

In some embodiments, the anti-TCRβV antibody molecule, e.g., anti-TCRβ V12 antibody molecule can contain any combination of CDRs or hypervariable loops according to the Kabat and Chothia definitions.

In an embodiment, e.g., an embodiment comprising a variable region, a CDR (e.g., a combined CDR, Chothia CDR or Kabat CDR), or other sequence referred to herein, e.g., in Table 14, the antibody molecule is a monospecific antibody molecule, a bispecific antibody molecule, a bivalent antibody molecule, a biparatopic antibody molecule, or an antibody molecule that comprises an antigen binding fragment of an antibody, e.g., a half antibody or antigen binding fragment of a half antibody. In certain embodiments the antibody molecule comprise a multispecific molecule, e.g., a bispecific molecule, e.g., as described herein.

In some embodiments, the anti-TCRβV antibody molecule, e.g., anti-TCRβ V12 antibody molecule includes:
  (i) one, two or all of a light chain complementarity determining region 1 (LC CDR1), a light chain complementarity determining region 2 (LC CDR2), and a light chain complementarity determining region 3 (LC CDR3) of SEQ ID NO: 16, SEQ ID NO: 26, SEQ ID NO: 27, SEQ ID NO: 28, SEQ ID NO: 29 or SEQ ID NO: 30, and/or
  (ii) one, two or all of a heavy chain complementarity determining region 1 (HC CDR1), heavy chain complementarity determining region 2 (HC CDR2), and a heavy chain complementarity determining region 3 (HC CDR3) of SEQ ID NO: 15, SEQ ID NO: 23, SEQ ID NO: 24 or SEQ ID NO: 25.

In some embodiments, the anti-TCRβV antibody molecule, e.g., anti-TCRβ V12 antibody molecule comprises:
  (i) a LC CDR1 amino acid sequence of SEQ ID NO: 20, a LC CDR2 amino acid sequence of SEQ ID NO: 21, or a LC CDR3 amino acid sequence of SEQ ID NO: 22; and/or
  (ii) a HC CDR1 amino acid sequence of SEQ ID NO: 17, a HC CDR2 amino acid sequence of SEQ ID NO: 18, or a HC CDR3 amino acid sequence of SEQ ID NO: 19.

In some embodiments, the anti-TCRβV antibody molecule, e.g., anti-TCRβ V12 antibody molecule comprises:
  (i) a light chain variable region (VL) comprising a LC CDR1 amino acid sequence of SEQ ID NO: 20, a LC CDR2 amino acid sequence of SEQ ID NO: 21, and a LC CDR3 amino acid sequence of SEQ ID NO: 2; and/or
  (ii) a heavy chain variable region (VH) comprising a HC CDR1 amino acid sequence of SEQ ID NO: 17, a HC CDR2 amino acid sequence of SEQ ID NO: 18, and a HC CDR3 amino acid sequence of SEQ ID NO: 19.

In some embodiments, the anti-TCRβV antibody molecule, e.g., anti-TCRβ V12 antibody molecule comprises:
  (i) a LC CDR1 amino acid sequence of SEQ ID NO: 63, a LC CDR2 amino acid sequence of SEQ ID NO: 64, or a LC CDR3 amino acid sequence of SEQ ID NO: 65; and/or
  (ii) a HC CDR1 amino acid sequence of SEQ ID NO: 57, a HC CDR2 amino acid sequence of SEQ ID NO: 58, or a HC CDR3 amino acid sequence of SEQ ID NO: 59.

In some embodiments, the anti-TCRβV antibody molecule, e.g., anti-TCRβ V12 antibody molecule comprises:
  (i) a light chain variable region (VL) comprising a LC CDR1 amino acid sequence of SEQ ID NO: 63, a LC CDR2 amino acid sequence of SEQ ID NO: 64, or a LC CDR3 amino acid sequence of SEQ ID NO: 65; and/or
  (ii) a heavy chain variable region (VH) comprising a HC CDR1 amino acid sequence of SEQ ID NO: 57, a HC CDR2 amino acid sequence of SEQ ID NO: 58, or a HC CDR3 amino acid sequence of SEQ ID NO: 59.

In some embodiments, the anti-TCRβV antibody molecule, e.g., anti-TCRβ V12 antibody molecule comprises:
  (i) a LC CDR1 amino acid sequence of SEQ ID NO: 66, a LC CDR2 amino acid sequence of SEQ ID NO: 67, or a LC CDR3 amino acid sequence of SEQ ID NO: 68; and/or
  (ii) a HC CDR1 amino acid sequence of SEQ ID NO: 60, a HC CDR2 amino acid sequence of SEQ ID NO: 61, or a HC CDR3 amino acid sequence of SEQ ID NO: 62.

In some embodiments, the anti-TCRβV antibody molecule, e.g., anti-TCRβ V12 antibody molecule comprises:
  (i) a light chain variable region (VL) comprising a LC CDR1 amino acid sequence of SEQ ID NO: 63, a LC CDR2 amino acid sequence of SEQ ID NO: 64, or a LC CDR3 amino acid sequence of SEQ ID NO: 65; and/or
  (ii) a heavy chain variable region (VH) comprising a HC CDR1 amino acid sequence of SEQ ID NO: 57, a HC CDR2 amino acid sequence of SEQ ID NO: 58, or a HC CDR3 amino acid sequence of SEQ ID NO: 59.

In one embodiment, the light or the heavy chain variable framework (e.g., the region encompassing at least FR1, FR2, FR3, and optionally FR4) of the anti-TCRβV antibody molecule, e.g., anti-TCRβ V12 antibody molecule can be chosen from: (a) a light or heavy chain variable framework including at least 80%, 85%, 87% 90%, 92%, 93%, 95%, 97%, 98%, or 100% of the amino acid residues from a human light or heavy chain variable framework, e.g., a light or heavy chain variable framework residue from a human mature antibody, a human germline sequence, or a human consensus sequence; (b) a light or heavy chain variable framework including from 20% to 80%, 40% to 60%, 60% to 90%, or 70% to 95% of the amino acid residues from a human light or heavy chain variable framework, e.g., a light or heavy chain variable framework residue from a human mature antibody, a human germline sequence, or a human consensus sequence; (c) a non-human framework (e.g., a rodent framework); or (d) a non-human framework that has been modified, e.g., to remove antigenic or cytotoxic determinants, e.g., deimmunized, or partially humanized. In one embodiment, the light or heavy chain variable framework region (particularly FR1, FR2 and/or FR3) includes a light or heavy chain variable framework sequence at least 70, 75, 80, 85, 87, 88, 90, 92, 94, 95, 96, 97, 98, 99% identical or identical to the frameworks of a VL or VH segment of a human germline gene.

Figure 5B:
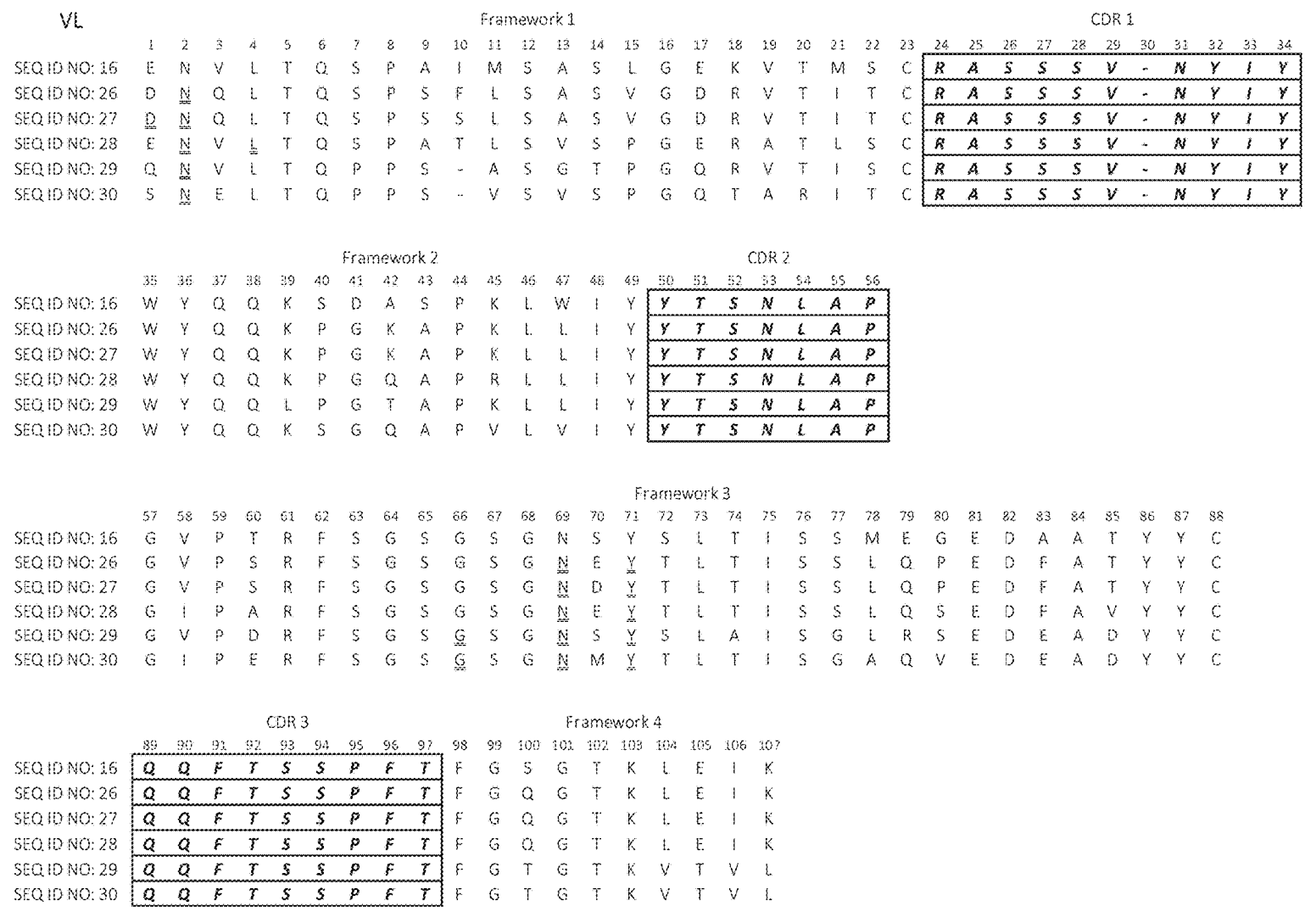

In some embodiments, the anti-TCRβV antibody molecule, e.g., anti-TCRβ V12 antibody molecule, comprises a heavy chain variable domain having at least one, two, three, four, five, six, seven, ten, fifteen, twenty or more changes, e.g., amino acid substitutions or deletions, from an amino acid sequence described in Table 14. e.g., the amino acid sequence of the FR region in the entire variable region, e.g., shown in FIGS. 5A and 5B, or in SEQ ID NOs: 23-25.

Alternatively, or in combination with the heavy chain substitutions described herein the anti-TCRβV antibody molecule, e.g., anti-TCRβ V12 antibody molecule comprises a light chain variable domain having at least one, two, three, four, five, six, seven, ten, fifteen, twenty or more amino acid changes, e.g., amino acid substitutions or deletions, from an amino acid sequence of an antibody described herein. e.g., the amino acid sequence of the FR region in the entire variable region, e.g., shown in FIGS. 5A and 5B, or in SEQ ID NOs: 26-30.

In some embodiments, the anti-TCRβV antibody molecule, e.g., anti-TCRβ V12 antibody molecule includes one, two, three, or four heavy chain framework regions shown in FIG. 5A, or a sequence substantially identical thereto.

In some embodiments, the anti-TCRβV antibody molecule, e.g., anti-TCRβ V12 antibody molecule includes one, two, three, or four light chain framework regions shown in FIG. 5B, or a sequence substantially identical thereto.

In some embodiments, the anti-TCRβV antibody molecule, e.g., anti-TCRβ V12 antibody molecule comprises the light chain framework region 1 e.g., as shown in FIG. 5B.

In some embodiments, the anti-TCRβV antibody molecule, e.g., anti-TCRβ V12 antibody molecule comprises the light chain framework region 2 e.g., as shown in FIG. 5B.

In some embodiments, the anti-TCRβV antibody molecule, e.g., anti-TCRβ V12 antibody molecule comprises the light chain framework region 3, e.g., as shown in FIG. 5B.

In some embodiments, the anti-TCRβV antibody molecule, e.g., anti-TCRβ V12 antibody molecule comprises the light chain framework region 4, e.g., as shown in FIG. 5B.

In some embodiments, the anti-TCRβV antibody molecule, e.g., anti-TCRβ V12 antibody molecule comprises a light chain comprising a framework region, e.g., framework region 1 (FR1), comprising a change, e.g., a substitution (e.g., a conservative substitution) at one or more, e.g., all, position disclosed herein according to Kabat numbering. In some embodiments, FR1 comprises an Aspartic Acid at position 1, e.g., a substitution at position 1 according to Kabat numbering, e.g., an Alanine to Aspartic Acid substitution. In some embodiments, FR1 comprises an Asparagine at position 2, e.g., a substitution at position 2 according to Kabat numbering, e.g., an Isoleucine to Asparagine substitution, Serine to Asparagine substitution or Tyrosine to Asparagine substitution. In some embodiments, FR1 comprises a Leucine at position 4, e.g., a substitution at position 4 according to Kabat numbering, e.g., a Methionine to Leucine substitution.

In some embodiments, the anti-TCRβV antibody molecule, e.g., anti-TCRβ V12 antibody molecule comprises a light chain comprising a framework region, e.g., framework region 1 (FR1), comprising a substitution at position 1 according to Kabat numbering, e.g., an Alanine to Aspartic Acid substitution, a substitution at position 2 according to Kabat numbering, e.g., an Isoleucine to Asparagine substitution, Serine to Asparagine substitution or Tyrosine to Asparagine substitution, and a substitution at position 4 according to Kabat numbering, e.g., a Methionine to Leucine substitution. In some embodiments, the anti-TCRβV antibody molecule, e.g., anti-TCRβ V12 antibody molecule comprises a light chain comprising a framework region, e.g., framework region 1 (FR1), comprising a substitution at position 1 according to Kabat numbering, e.g., an Alanine to Aspartic Acid substitution, and a substitution at position 2 according to Kabat numbering, e.g., an Isoleucine to Asparagine substitution, Serine to Asparagine substitution or Tyrosine to Asparagine substitution. In some embodiments, the anti-TCRβV antibody molecule, e.g., anti-TCRβ V12 antibody molecule comprises a light chain comprising a framework region, e.g., framework region 1 (FR1), comprising a substitution at position 1 according to Kabat numbering, e.g., an Alanine to Aspartic Acid substitution, and a substitution at position 4 according to Kabat numbering, e.g., a Methionine to Leucine substitution. In some embodiments, the anti-TCRβV antibody molecule, e.g., anti-TCRβ V12 antibody molecule comprises a light chain comprising a framework region, e.g., framework region 1 (FR1), comprising a substitution at position 2 according to Kabat numbering, e.g., an Isoleucine to Asparagine substitution, Serine to Asparagine substitution or Tyrosine to Asparagine substitution, and a substitution at position 4 according to Kabat numbering, e.g., a Methionine to Leucine substitution. In some embodiments, the substitution is relative to a human germline light chain framework region sequence.

In some embodiments, the anti-TCRβV antibody molecule, e.g., anti-TCRβ V12 antibody molecule comprises a light chain comprising a framework region, e.g., framework region 3 (FR3), comprising a change, e.g., a substitution (e.g., a conservative substitution) at one or more, e.g., all, position disclosed herein according to Kabat numbering. In some embodiments, FR3 comprises a Glycine at position 66, e.g., a substitution at position 66 according to Kabat numbering, e.g., a Lysine to Glycine substitution, or a Serine to Glycine substitution. In some embodiments, FR3 comprises an Asparagine at position 69, e.g., a substitution at position 69 according to Kabat numbering, e.g., a Tyrosine to Asparagine substitution. In some embodiments, FR3 comprises a Tyrosine at position 71, e.g., a substitution at position 71 according to Kabat numbering, e.g., a Phenylalanine to Tyrosine substitution, or an Alanine to Tyrosine substitution.

In some embodiments, the anti-TCRβV antibody molecule, e.g., anti-TCRβ V12 antibody molecule comprises a light chain comprising a framework region, e.g., framework region 3 (FR3), comprising a substitution at position 66 according to Kabat numbering, e.g., a Lysine to Glycine substitution, or a Serine to Glycine substitution, and a substitution at position 69 according to Kabat numbering, e.g., a Tyrosine to Asparagine substitution. In some embodiments, the anti-TCRβV antibody molecule, e.g., anti-TCRβ V12 antibody molecule comprises a light chain comprising a framework region, e.g., framework region 3 (FR3), comprising a substitution at position 66 according to Kabat numbering, e.g., Lysine to Glycine substitution, or a Serine to Glycine substitution, and a substitution at position 71 according to Kabat numbering, e.g., a Phenylalanine to Tyrosine substitution, or an Alanine to Tyrosine substitution. In some embodiments, the anti-TCRβV antibody molecule, e.g., anti-TCRβ V12 antibody molecule comprises a light chain comprising a framework region, e.g., framework region 3 (FR3), comprising a substitution at position 69 according to Kabat numbering, e.g., a Tyrosine to Asparagine substitution and a substitution at position 71 according to Kabat numbering, e.g., a Phenylalanine to Tyrosine substitution, or an Alanine to Tyrosine substitution. In some embodiments, the anti-TCRβV antibody molecule, e.g., anti-TCRβ V12 antibody molecule comprises a light chain comprising a framework region, e.g., framework region 3 (FR3), comprising a substitution at position 66 according to Kabat numbering, e.g., a Lysine to Glycine substitution, or a Serine to Glycine substitution, a substitution at position 69 according to Kabat numbering, e.g., a Tyrosine to Asparagine substitution and a substitution at position 71 according to Kabat numbering, e.g., a Phenylalanine to Tyrosine substitution, or an Alanine to Tyrosine substitution. In some embodiments, the substitution is relative to a human germline light chain framework region sequence.

In some embodiments, the anti-TCRβV antibody molecule, e.g., anti-TCRβ V12 antibody molecule comprises a light chain comprising: a framework region 1 (FR1) comprising a substitution at position 2 according to Kabat numbering, e.g., a Isoleucine to Asparagine substitution; and a framework region 3 (FR3), comprising a substitution at position 69 according to Kabat numbering, e.g., a Threonine to Asparagine substitution and a substitution at position 71 according to Kabat numbering, e.g., a Phenylalanine to Tyrosine substitution, e.g., as shown in the amino acid sequence of SEQ ID NO: 26. In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 1 according to Kabat numbering, e.g., a Alanine to Aspartic Acid substitution, and a substitution at position 2 according to Kabat numbering, e.g., a Isoleucine to Asparagine substitution; and (b) a framework region 3 (FR3), comprising a substitution at position 69 according to Kabat numbering, e.g., a Threonine to Asparagine substitution and a substitution at position 71 according to Kabat numbering, e.g., a Phenylalanine to Tyrosine substitution, e.g., as shown in the amino acid sequence of SEQ ID NO: 27 In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 2 according to Kabat numbering, e.g., a Serine to Asparagine substitution; and a substitution at position 4 according to Kabat numbering, e.g., a Methionine to Leucine substitution; and (b) a framework region 3 (FR3), comprising a substitution at position 69 according to Kabat numbering, e.g., a Threonine to Asparagine substitution and a substitution at position 71 according to Kabat numbering, e.g., a Phenylalanine to Tyrosine substitution, e.g., as shown in the amino acid sequence of SEQ ID NO: 28 In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 2 according to Kabat numbering, e.g., a Serine to Asparagine substitution; and (b) a framework region 3 (FR3) comprising a substitution at position 66 according to Kabat numbering, e.g., a Lysine to Glycine substitution; a substitution at position 69 according to Kabat numbering, e.g., a Threonine to Asparagine substitution; and a substitution at position 71 according to Kabat numbering, e.g., a Alanine to Tyrosine substitution, e.g., as shown in the amino acid sequence of SEQ ID NO: 29. In some embodiments, the substitution is relative to a human germline light chain framework region sequence.

In some embodiments, the anti-TCRβV antibody molecule, e.g., anti-TCRβ V12 antibody molecule comprises a light chain comprising: (a) a framework region 1 (FR1) comprising a substitution at position 2 according to Kabat numbering, e.g., a Tyrosine to Asparagine substitution; and (b) a framework region 3 (FR3) comprising a substitution at position 66 according to Kabat numbering, e.g., a Serine to Glycine substitution; a substitution at position 69 according to Kabat numbering, e.g., a Threonine to Asparagine substitution; and a substitution at position 71 according to Kabat numbering, e.g., a Alanine to Tyrosine substitution, e.g., as shown in the amino acid sequence of SEQ ID NO: 29. In some embodiments, the substitution is relative to a human germline light chain framework region sequence.

In some embodiments, the anti-TCRβV antibody molecule, e.g., anti-TCRβ V12 antibody molecule comprises a light chain variable domain comprising: (a) a framework region 1 (FR1) comprising a change, e.g., a substitution (e.g., a conservative substitution) at one or more (e.g., all) positions disclosed herein according to Kabat numbering, and (b) a framework region 3 (FR3) comprising a change, e.g., a substitution (e.g., a conservative substitution) at one or more (e.g., all) position disclosed herein according to Kabat numbering. In some embodiments, the substitution is relative to a human germline light chain framework region sequence.

In some embodiments, the anti-TCRβV antibody molecule, e.g., anti-TCRβ V12 antibody molecule comprises the heavy chain framework region 1, e.g., as shown in FIG. 5A.

In some embodiments, the anti-TCRβV antibody molecule, e.g., anti-TCRβ V12 antibody molecule comprises the heavy chain framework region 2, e.g., as shown in FIG. 5A.

In some embodiments, the anti-TCRβV antibody molecule, e.g., anti-TCRβ V12 antibody molecule comprises the heavy chain framework region 3, e.g., as shown in FIG. 5A.

In some embodiments, the anti-TCRβV antibody molecule, e.g., anti-TCRβ V12 antibody molecule comprises the heavy chain framework region 4, e.g., as shown in FIG. 5A.

In some embodiments, the anti-TCRβV antibody molecule, e.g., anti-TCRβ V12 antibody molecule comprises the heavy chain framework regions 1-4, e.g., SEQ ID NOS: 20-23, or as shown in FIG. 5A.

In some embodiments, the anti-TCRβV antibody molecule, e.g., anti-TCRβ V12 antibody molecule comprises the light chain framework regions 1-4, e.g., SEQ ID NOs: 26-30, or as shown in FIG. 5B.

In some embodiments, the anti-TCRβV antibody molecule, e.g., anti-TCRβ V12 antibody molecule comprises the heavy chain framework regions 1-4, e.g., SEQ ID NOs: 23-25; and the light chain framework regions 1-4, e.g., SEQ ID NOs: 26-30, or as shown in FIGS. 5A and 5B.

In some embodiments, the heavy or light chain variable domain, or both, of, the anti-TCRβV antibody molecule, e.g., anti-TCRβ V12 antibody molecule includes an amino acid sequence, which is substantially identical to an amino acid disclosed herein, e.g., at least 80%, 85%, 90%, 92%, 95%, 97%, 98%, 99% or higher identical to a variable region of an antibody described herein, e.g., an antibody as described in Table 14, or encoded by the nucleotide sequence in Table 14; or which differs at least 1 or 5 residues, but less than 40, 30, 20, or 10 residues, from a variable region of an antibody described herein.

In some embodiments, the anti-TCRβV antibody molecule, e.g., anti-TCRβ V12 antibody molecule comprises at least one, two, three, or four antigen-binding regions, e.g., variable regions, having an amino acid sequence as set forth in Table 14, or a sequence substantially identical thereto (e.g., a sequence at least about 85%, 90%, 95%, 99% or more identical thereto, or which differs by no more than 1, 2, 5, 10, or 15 amino acid residues from the sequences shown in Table 14. In another embodiment, the anti-TCRβV antibody molecule, e.g., anti-TCRβ V12 antibody molecule includes a VH and/or VL domain encoded by a nucleic acid having a nucleotide sequence as set forth in Table 14, or a sequence substantially identical thereto (e.g., a sequence at least about 85%, 90%, 95%, 99% or more identical thereto, or which differs by no more than 3, 6, 15, 30, or 45 nucleotides from the sequences shown in Table 14.

In some embodiments, the anti-TCRβV antibody molecule, e.g., anti-TCRβ V12 antibody molecule comprises:
 a VH domain comprising an amino acid sequence chosen from the amino acid sequence of SEQ ID NO: 23, SEQ ID NO:24 or SEQ ID NO:25, an amino acid sequence at least about 85%, 90%, 95%, 99% or more identical to the amino acid sequence SEQ ID NO: 23, SEQ ID NO:24 or SEQ ID NO:25, or an amino acid sequence which differs by no more than 1, 2, 5, 10, or 15 amino acid residues from the amino acid sequence of SEQ ID NO: 23, SEQ ID NO:24 or SEQ ID NO:25; and/or
 a VL domain comprising an amino acid sequence chosen from the amino acid sequence of SEQ ID NO: 26, SEQ ID NO: 27, SEQ ID NO: 28, SEQ ID NO: 29 or SEQ ID NO: 30, an amino acid sequence at least about 85%, 90%, 95%, 99% or more identical to the amino acid sequence of SEQ ID NO: 26, SEQ ID NO: 27, SEQ ID NO: 28, SEQ ID NO: 29 or SEQ ID NO: 30, or an amino acid sequence which differs by no more than 1, 2, 5, 10, or 15 amino acid residues from the amino acid sequence of SEQ ID NO: 26, SEQ ID NO: 27, SEQ ID NO: 28, SEQ ID NO: 29 or SEQ ID NO: 30.

In some embodiments, the anti-TCRβV antibody molecule, e.g., anti-TCRβ V12 antibody molecule comprises:
 a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and
 a VL domain comprising the amino acid sequence of SEQ ID NO: 26, an amino acid sequence at least about 85%, 90%, 95%, 99% or more identical to the amino acid sequence SEQ ID NO: 26, or an amino acid sequence which differs by no more than 1, 2, 5, 10, or 15 amino acid residues from the amino acid sequence of SEQ ID NO: 26.

In some embodiments, the anti-TCRβV antibody molecule, e.g., anti-TCRβ V12 antibody molecule comprises:
 a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and
 a VL domain comprising the amino acid sequence of SEQ ID NO: 27, an amino acid sequence at least about 85%, 90%, 95%, 99% or more identical to the amino acid sequence SEQ ID NO: 27, or an amino acid sequence which differs by no more than 1, 2, 5, 10, or 15 amino acid residues from the amino acid sequence of SEQ ID NO: 27.

In some embodiments, the anti-TCRβV antibody molecule, e.g., anti-TCRβ V12 antibody molecule comprises:
 a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and
 a VL domain comprising the amino acid sequence of SEQ ID NO: 28, an amino acid sequence at least about 85%, 90%, 95%, 99% or more identical to the amino acid sequence SEQ ID NO: 28, or an amino acid sequence which differs by no more than 1, 2, 5, 10, or 15 amino acid residues from the amino acid sequence of SEQ ID NO: 28.

In some embodiments, the anti-TCRβV antibody molecule, e.g., anti-TCRβ V12 antibody molecule comprises:
 a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and
 a VL domain comprising the amino acid sequence of SEQ ID NO: 29, an amino acid sequence at least about 85%, 90%, 95%, 99% or more identical to the amino acid sequence SEQ ID NO: 29, or an amino acid sequence which differs by no more than 1, 2, 5, 10, or 15 amino acid residues from the amino acid sequence of SEQ ID NO: 29.

In some embodiments, the anti-TCRβV antibody molecule, e.g., anti-TCRβ V12 antibody molecule comprises:
- a VH domain comprising the amino acid sequence of SEQ ID NO: 23, an amino acid sequence at least about 85%, 90%, 95%, 99% or more identical to the amino acid sequence SEQ ID NO: 23, or an amino acid sequence which differs by no more than 1, 2, 5, 10, or 15 amino acid residues from the amino acid sequence of SEQ ID NO: 23; and
- a VL domain comprising the amino acid sequence of SEQ ID NO: 30, an amino acid sequence at least about 85%, 90%, 95%, 99% or more identical to the amino acid sequence SEQ ID NO: 30, or an amino acid sequence which differs by no more than 1, 2, 5, 10, or 15 amino acid residues from the amino acid sequence of SEQ ID NO: 30.

In some embodiments, the anti-TCRβV antibody molecule, e.g., anti-TCRβ V12 antibody molecule comprises:
- a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and
- a VL domain comprising the amino acid sequence of SEQ ID NO: 26, an amino acid sequence at least about 85%, 90%, 95%, 99% or more identical to the amino acid sequence SEQ ID NO: 26, or an amino acid sequence which differs by no more than 1, 2, 5, 10, or 15 amino acid residues from the amino acid sequence of SEQ ID NO: 26.

In some embodiments, the anti-TCRβV antibody molecule, e.g., anti-TCRβ V12 antibody molecule comprises:
- a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and
- a VL domain comprising the amino acid sequence of SEQ ID NO: 27, an amino acid sequence at least about 85%, 90%, 95%, 99% or more identical to the amino acid sequence SEQ ID NO: 27, or an amino acid sequence which differs by no more than 1, 2, 5, 10, or 15 amino acid residues from the amino acid sequence of SEQ ID NO: 27.

In some embodiments, the anti-TCRβV antibody molecule, e.g., anti-TCRβ V12 antibody molecule comprises:
- a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and
- a VL domain comprising the amino acid sequence of SEQ ID NO: 28, an amino acid sequence at least about 85%, 90%, 95%, 99% or more identical to the amino acid sequence SEQ ID NO: 28, or an amino acid sequence which differs by no more than 1, 2, 5, 10, or 15 amino acid residues from the amino acid sequence of SEQ ID NO: 28.

In some embodiments, the anti-TCRβV antibody molecule, e.g., anti-TCRβ V12 antibody molecule comprises:
- a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and
- a VL domain comprising the amino acid sequence of SEQ ID NO: 29, an amino acid sequence at least about 85%, 90%, 95%, 99% or more identical to the amino acid sequence SEQ ID NO: 29, or an amino acid sequence which differs by no more than 1, 2, 5, 10, or 15 amino acid residues from the amino acid sequence of SEQ ID NO: 29.

In some embodiments, the anti-TCRβV antibody molecule, e.g., anti-TCRβ V12 antibody molecule comprises:
- a VH domain comprising the amino acid sequence of SEQ ID NO: 24, an amino acid sequence at least about 85%, 90%, 95%, 99% or more identical to the amino acid sequence SEQ ID NO: 24, or an amino acid sequence which differs by no more than 1, 2, 5, 10, or 15 amino acid residues from the amino acid sequence of SEQ ID NO: 24; and
- a VL domain comprising the amino acid sequence of SEQ ID NO: 30, an amino acid sequence at least about 85%, 90%, 95%, 99% or more identical to the amino acid sequence SEQ ID NO: 30, or an amino acid sequence which differs by no more than 1, 2, 5, 10, or 15 amino acid residues from the amino acid sequence of SEQ ID NO: 30.

In some embodiments, the anti-TCRβV antibody molecule, e.g., anti-TCRβ V12 antibody molecule comprises:
- a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and
- a VL domain comprising the amino acid sequence of SEQ ID NO: 26, an amino acid sequence at least about 85%, 90%, 95%, 99% or more identical to the amino acid sequence SEQ ID NO: 26, or an amino acid sequence which differs by no more than 1, 2, 5, 10, or 15 amino acid residues from the amino acid sequence of SEQ ID NO: 26.

In some embodiments, the anti-TCRβV antibody molecule, e.g., anti-TCRβ V12 antibody molecule comprises:
- a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and
- a VL domain comprising the amino acid sequence of SEQ ID NO: 27, an amino acid sequence at least about 85%, 90%, 95%, 99% or more identical to the amino acid sequence SEQ ID NO: 27, or an amino acid sequence which differs by no more than 1, 2, 5, 10, or 15 amino acid residues from the amino acid sequence of SEQ ID NO: 27.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 28, an amino acid sequence at least about 85%, 90%, 95%, 99% or more identical to the amino acid sequence SEQ ID NO: 28, or an amino acid sequence which differs by no more than 1, 2, 5, 10, or 15 amino acid residues from the amino acid sequence of SEQ ID NO: 28.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 29, an amino acid sequence at least about 85%, 90%, 95%, 99% or more identical to the amino acid sequence SEQ ID NO: 29, or an amino acid sequence which differs by no more than 1, 2, 5, 10, or 15 amino acid residues from the amino acid sequence of SEQ ID NO: 29.

In some embodiments, the anti-TCRβV antibody molecule, e.g., anti-TCRβ V12 antibody molecule comprises:

a VH domain comprising the amino acid sequence of SEQ ID NO: 25, an amino acid sequence at least about 85%, 90%, 95%, 99% or more identical to the amino acid sequence SEQ ID NO: 25, or an amino acid sequence which differs by no more than 1, 2, 5, 10, or 15 amino acid residues from the amino acid sequence of SEQ ID NO: 25; and a VL domain comprising the amino acid sequence of SEQ ID NO: 30, an amino acid sequence at least about 85%, 90%, 95%, 99% or more identical to the amino acid sequence SEQ ID NO: 30, or an amino acid sequence which differs by no more than 1, 2, 5, 10, or 15 amino acid residues from the amino acid sequence of SEQ ID NO: 30.

In some embodiments, the anti-TCRβV antibody molecule, e.g., anti-TCRβ V12 antibody molecule is a full antibody or fragment thereof (e.g., a Fab, F(ab')₂, Fv, or a single chain Fv fragment (scFv)). In embodiments, the anti-TCRβV antibody molecule, e.g., anti-TCRβ V6 (e.g., anti-TCRβ V6-5*01) antibody molecule is a monoclonal antibody or an antibody with single specificity. In some embodiments, the anti-TCRβV antibody molecule, e.g., anti-TCRβ V12 antibody molecule, can also be a humanized, chimeric, camelid, shark, or an in vitro-generated antibody molecule. In some embodiments, the anti-TCRβV antibody molecule, e.g., anti-TCRβ V12 antibody molecule is a humanized antibody molecule. The heavy and light chains of the anti-TCRβV antibody molecule, e.g., anti-TCRβ V12 antibody molecule can be full-length (e.g., an antibody can include at least one, and preferably two, complete heavy chains, and at least one, and preferably two, complete light chains) or can include an antigen-binding fragment (e.g., a Fab, F(ab')2, Fv, a single chain Fv fragment, a single domain antibody, a diabody (dAb), a bivalent antibody, or bispecific antibody or fragment thereof, a single domain variant thereof, or a camelid antibody).

In some embodiments, the anti-TCRβV antibody molecule, e.g., anti-TCRβ V12 antibody molecule is in the form of a multispecific molecule, e.g., a bispecific molecule, e.g., as described herein.

In some embodiments, the anti-TCRβV antibody molecule, e.g., anti-TCRβ V12 antibody molecule has a heavy chain constant region (Fc) chosen from, e.g., the heavy chain constant regions of IgG1, IgG2, IgG3, IgG4, IgM, IgA1, IgA2, IgD, and IgE. In some embodiments, the Fc region is chosen from the heavy chain constant regions of IgG1, IgG2, IgG3, and IgG4. In some embodiments, the Fc region is chosen from the heavy chain constant region of IgG1 or IgG2 (e.g., human IgG1, or IgG2). In some embodiments, the heavy chain constant region is human IgG1.

In some embodiments, the anti-TCRβV antibody molecule, e.g., anti-TCRβ V12 antibody molecule has a light chain constant region chosen from, e.g., the light chain constant regions of kappa or lambda, preferably kappa (e.g., human kappa). In one embodiment, the constant region is altered, e.g., mutated, to modify the properties of the anti-TCRβV antibody molecule, e.g., anti-TCRβ V12 antibody molecule (e.g., to increase or decrease one or more of: Fc receptor binding, antibody glycosylation, the number of cysteine residues, effector cell function, or complement function). For example, the constant region is mutated at positions 296 (M to Y), 298 (S to T), 300 (T to E), 477 (H to K) and 478 (N to F) to alter Fc receptor binding (e.g., the mutated positions correspond to positions 132 (M to Y), 134 (S to T), 136 (T to E), 313 (H to K) and 314 (N to F) of SEQ ID NOs: 212 or 214; or positions 135 (M to Y), 137 (S to T), 139 (T to E), 316 (H to K) and 317 (N to F) of SEQ ID NOs: 215, 216, 217 or 218).

TABLE 14

Amino acid and nucleotide sequences for murine and humanized antibody molecules. The antibody molecules include murine mAb 16G8 and humanized mAb 16G8. The amino acid the heavy and light chain CDRs, and the amino acid and nucleotide sequences of the heavy and light chain variable regions, and the heavy and light chains are shown.

16G8 (murine)

| | | |
|---|---|---|
| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 57 | HC CDR1 (Kabat) | NFGMH |
| SEQ ID NO: 58 | HC CDR2 (Kabat) | YISSGSSTIYYADTLKG |
| SEQ ID NO: 59 | HC CDR3 (Kabat) | RGEGAMDY |
| SEQ ID NO: 60 | HC CDR1 (Chothia) | GFTFSNF |
| SEQ ID NO: 61 | HC CDR2 (Chothia) | SSGSST |
| SEQ ID NO: 62 | HC CDR3 (Chothia) | RGEGAMDY |
| SEQ ID NO: 15 | VH | DVQLVESGGGLVQPGGSRKLSCAASGFTFSNFGMHW |

TABLE 14-continued

Amino acid and nucleotide sequences for murine and humanized antibody molecules.
The antibody molecules include murine mAb 16G8 and humanized mAb 16G8. The amino acid
the heavy and light chain CDRs, and the amino acid and nucleotide sequences of the heavy and
light chain variable regions, and the heavy and light chains are shown.

|  |  |  |
|---|---|---|
|  |  | VRQAPDKGLEWVAYISSGSSTIYYADTLKGRFTISRD |
|  |  | NPKNTLFLQMTSLRSEDTAMYYCARRGEGAMDYWG |
|  |  | QGTSVTVSS |
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3 (Combined) | QQFTSSPFT |
| SEQ ID NO: 63 | LC CDR1 (Kabat) | RASSSVNYIY |
| SEQ ID NO: 64 | LC CDR2 (Kabat) | YTSNLAP |
| SEQ ID NO: 65 | LC CDR3 (Kabat) | QQFTSSPFT |
| SEQ ID NO: 66 | LC CDR1 (Chothia) | RASSSVNYIY |
| SEQ ID NO: 67 | LC CDR2 (Chothia) | YTSNLAP |
| SEQ ID NO: 68 | LC CDR3 (Chothia) | QQFTSSPFT |
| SEQ ID NO: 16 | VL | ENVLTQSPAIMSASLGEKVTMSCRASSSVNYIYWYQQ |
|  |  | KSDASPKLWIYYTSNLAPGVPTRFSGSGSGNSYSLTIS |
|  |  | SMEGEDAATYYCQQFTSSPFTFGSGTKLEIK |

16G8 humanized HC-1

| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 23 | VH | EVQLVESGGGLVQPGGSLRLSCAASGFTFSNFGMHW |
|  |  | VRQAPGKGLEWVSYISSGSSTIYYADTLKGRFTISRDN |
|  |  | AKNSLYLQMNSLRAEDTAVYYCARRGEGAMDYWG |
|  |  | QGTTVTVSS |
| SEQ ID NO: 31 | DNA VH | GAGGTGCAGCTGGTTGAATCTGGCGGAGGATTGGT |
|  |  | TCAGCCTGGCGGCTCTCTGAGACTGTCTTGTGCCGC |
|  |  | TTCTGGCTTCACCTTCTCCAACTTCGGCATGCACTG |
|  |  | GGTCCGACAGGCCCCTGGAAAAGGACTGGAATGGG |
|  |  | TGTCCTACATCTCCTCCGGCTCCTCCACCATCTACT |
|  |  | ACGCTGACACCCTGAAGGGCAGATTCACCATCTCT |
|  |  | CGGGACAACGCCAAGAACTCCCTGTACCTGCAGAT |
|  |  | GAACAGCCTGAGAGCCGAGGACACCGCCGTGTACT |
|  |  | ACTGTGCTAGAAGAGGCGAGGGCGCCATGGATTAT |
|  |  | TGGGGCCAGGGAACCACAGTGACCGTGTCTAGC |

16G8 humanized HC-2

| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 24 | VH | EVQLVESGGGLVQPGGSLRLSCAASGFTFSNFGMHW |
|  |  | VRQAPGKGLEWVSYISSGSSTIYYADTLKGRFTISRDN |
|  |  | SKNTLYLQMNSLRAEDTAVYYCARRGEGAMDYWG |
|  |  | QGTTVTVSS |
| SEQ ID NO: 32 | DNA VH | GAGGTGCAGCTGGTTGAATCTGGCGGAGGATTGGT |
|  |  | TCAGCCTGGCGGCTCTCTGAGACTGTCTTGTGCCGC |
|  |  | TTCTGGCTTCACCTTCTCCAACTTCGGCATGCACTG |
|  |  | GGTCCGACAGGCCCCTGGAAAAGGACTGGAATGGG |
|  |  | TGTCCTACATCTCCTCCGGCTCCTCCACCATCTACT |
|  |  | ACGCTGACACCCTGAAGGGCAGATTCACCATCAGC |
|  |  | CGGGACAACTCCAAGAACACCCTGTACCTGCAGAT |
|  |  | GAACTCCCTGAGAGCCGAGGACACCGCCGTGTACT |
|  |  | ACTGTGCTAGAAGAGGCGAGGGCGCCATGGATTAT |
|  |  | TGGGGCCAGGGAACCACAGTGACCGTGTCTAGC |

16G8 humanized HC-3

| SEQ ID NO: 17 | HC CDR1 (Combined) | GFTFSNFGMH |
| SEQ ID NO: 18 | HC CDR2 (Combined) | YISSGSSTIYYADTLKG |
| SEQ ID NO: 19 | HC CDR3 (Combined) | RGEGAMDY |
| SEQ ID NO: 25 | VH | QVQLVESGGGVVQPGRSLRLSCAASGFTFSNFGMHW |
|  |  | VRQAPGKGLEWVAYISSGSSTIYYADTLKGRFTISRD |
|  |  | NSKNTLYLQMNSLRAEDTAVYYCARRGEGAMDYW |
|  |  | GQGTTVTVSS |
| SEQ ID NO: 33 | DNA VH | CAGGTGCAGCTGGTGGAATCTGGTGGCGGAGTTGT |
|  |  | GCAGCCTGGCAGATCCCTGAGACTGTCTTGTGCCGC |
|  |  | CTCTGGCTTCACCTTCTCCAACTTCGGCATGCACTG |
|  |  | GGTCCGACAGGCCCCTGGAAAAGGATTGGAGTGGG |
|  |  | TCGCCTACATCTCCTCCGGCTCCTCCACCATCTACT |
|  |  | ACGCTGACACCCTGAAGGGCAGATTCACCATCAGC |
|  |  | CGGGACAACTCCAAGAACACCCTGTACCTGCAGAT |
|  |  | GAACTCCCTGAGAGCCGAGGACACCGCCGTGTACT |
|  |  | ACTGTGCTAGAAGAGGCGAGGGCGCCATGGATTAT |
|  |  | TGGGGCCAGGGAACCACAGTGACCGTGTCTAGC |

TABLE 14-continued

Amino acid and nucleotide sequences for murine and humanized antibody molecules.
The antibody molecules include murine mAb 16G8 and humanized mAb 16G8. The amino acid
the heavy and light chain CDRs, and the amino acid and nucleotide sequences of the heavy and
light chain variable regions, and the heavy and light chains are shown.

16G8 humanized LC-1

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3(Combined) | QQFTSSPFT |
| SEQ ID NO: 26 | VL | DNQLTQSPSFLSASVGDRVTITCRASSSVNYIYWYQQ KPGKAPKLLIYYTSNLAPGVPSRFSGSGSGNEYTLTISS LQPEDFATYYCQQFTSSPFTFGQGTKLEIK |
| SEQ ID NO: 34 | DNA VL | GATAACCAGCTGACCCAGTCTCCTAGCTTCCTGTCT GCCTCTGTGGGCGACAGAGTGACAATTACCTGCCG GCCTCCTCCTCCGTGAACTACATCTACTGGTATCA GCAGAAGCCCGGCAAGGCCCCTAAGCTGCTGATCT ACTACACCTCCAATCTGGCCCCTGGCGTGCCCTCTA GATTTTCCGGATCTGGCTCCGGCAACGAGTATACCC TGACAATCTCCAGCCTGCAGCCTGAGGACTTCGCC ACCTACTACTGCCAGCAGTTCACCTCCTCTCCATTC ACCTTTGGCCAGGGCACCAAGCTGGAAATCAAA |

16G8 humanized LC-2

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3(Combined) | QQFTSSPFT |
| SEQ ID NO: 27 | VL | DNQLTQSPSSLSASVGDRVTITCRASSSVNYIYWYQQ KPGKAPKLLIYYTSNLAPGVPSRFSGSGSGNDYTLTIS SLQPEDFATYYCQQFTSSPFTFGQGTKLEIK |
| SEQ ID NO: 35 | DNA VL | ATAACCAGCTGACCCAGTCTCCTTCCAGCCTGTCTG CTTCTGTGGGCGACAGAGTGACAATTACCTGCCGG GCCTCCTCCTCCGTGAACTACATCTACTGGTATCAG CAGAAGCCCGGCAAGGCCCCTAAGCTGCTGATCTA CTACACCTCCAATCTGGCCCCTGGCGTGCCCTCTAG ATTTTCCGGATCTGGCTCCGGCAACGACTATACCCT GACAATCTCCAGCCTGCAGCCTGAGGACTTCGCCA CCTACTACTGCCAGCAGTTCACCTCCTCTCCATTCA CCTTTGGCCAGGGCACCAAGCTGGAAATCAAA |

16G8 humanized LC-3

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3(Combined) | QQFTSSPFT |
| SEQ ID NO: 28 | VL | ENVLTQSPATLSVSPGERATLSCRASSSVNYIYWYQQ KPGQAPRLLIYYTSNLAPGIPARFSGSGSGNEYTLTISS LQSEDFAVYYCQQFTSSPFTFGQGTKLEIK |
| SEQ ID NO: 36 | DNA VL | GAGAATGTGCTGACCCAGTCTCCTGCCACACTGTCT GTTAGCCCTGGCGAGAGAGCTACCCTGAGCTGCAG AGCCTCTTCCTCCGTGAACTACATCTACTGGTATCA GCAGAAGCCCGGCCAGGCTCCTAGACTGCTGATCT ACTACACCTCCAATCTGGCCCCTGGCATCCCTGCCA GATTTTCCGGATCTGGCTCCGGCAACGAGTATACCC TGACCATCTCCAGCCTGCAGTCCGAGGACTTTGCTG TGTACTATTGCCAGCAGTTCACAAGCAGCCCTTTCA CCTTTGGCCAGGGCACCAAGCTGGAAATCAAA |

16G8 humanized LC-4

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3(Combined) | QQFTSSPFT |
| SEQ ID NO: 29 | VL | QNVLTQPPSASGTPGQRVTISCRASSSVNYIYWYQQL PGTAPKLLIYYTSNLAPGVPDRFSGSGSGNSYSLAISG LRSEDEADYYCQQFTSSPFTFGTGTKVTVL |
| SEQ ID NO: 37 | DNA VL | CAGAATGTGCTGACCCAACCTCCTTCCGCCTCTGGC ACACCTGGACAGAGAGTGACAATCTCCTGCCGGGC CTCCTCCTCCGTGAACTACATCTACTGGTATCAGCA GCTGCCCGGCACCGCTCCTAAACTGCTGATCTACTA CACCTCCAATCTGGCCCCTGGCGTGCCCGATAGATT TTCCGGATCTGGCTCCGGCAACTCCTACAGCCTGGC TATCTCTGGCCTGAGATCTGAGGACGAGGCCGACT ACTACTGCCAGCAGTTCACCTCCTCTCCATTCACCT TTGGCACCGGCACCAAAGTGACAGTTCTT |

TABLE 14-continued

Amino acid and nucleotide sequences for murine and humanized antibody molecules.
The antibody molecules include murine mAb 16G8 and humanized mAb 16G8. The amino acid
the heavy and light chain CDRs, and the amino acid and nucleotide sequences of the heavy and
light chain variable regions, and the heavy and light chains are shown.

16G8 humanized LC-5

| | | |
|---|---|---|
| SEQ ID NO: 20 | LC CDR1 (Combined) | RASSSVNYIY |
| SEQ ID NO: 21 | LC CDR2 (Combined)) | YTSNLAP |
| SEQ ID NO: 22 | LC CDR3 (Combined) | QQFTSSPFT |
| SEQ ID NO: 30 | VL | SNELTQPPSVSVSPGQTARITCRASSSVNYIYWYQQKS |
| | | GQAPVLVIYYTSNLAPGIPERFSGSGSGNMYTLTISGA |
| | | QVEDEADYYCQQFTSSPFTFGTGTKVTVL |
| SEQ ID NO: 38 | DNA VL | TCTAATGAGCTGACCCAGCCTCCTTCCGTGTCCGTG |
| | | TCTCCTGGACAGACCGCCAGAATTACCTGCCGGGC |
| | | CTCCTCCTCCGTGAACTACATCTACTGGTATCAGCA |
| | | GAAGTCCGGCCAGGCTCCTGTGCTCGTGATCTACTA |
| | | CACCTCCAATCTGGCCCCTGGCATCCCTGAGAGATT |
| | | CTCCGGATCTGGCTCCGGCAACATGTACACCCTGAC |
| | | CATCTCTGGCGCCCAGGTGGAAGATGAGGCCGACT |
| | | ACTACTGCCAGCAGTTCACCTCCTCTCCATTCACCT |
| | | TTGGCACCGGCACCAAAGTGACAGTTCTT |

TABLE 17

Constant region amino acid sequences of human IgG heavy chains and human kappa light chain

| | | |
|---|---|---|
| Human kappa constant region SEQ ID NO: 39 | LC | RTVAAPSVFI FPPSDEQLKS GTASVVCLLN NFYPREAKVQ WKVDNALQSG NSQESVTEQD SKDSTYSLSS TLTLSKADYE KFIKVYACEVT HQGLSSPVTK SFNRGEC |
| IgG4 (S228P) mutant constant region (EU Numbering) SEQ ID NO: 40 | HC | ASTKGPSVFPLAPCSRSTSESTAALGCLVKDYFPEPVTVSWNSGALTSG VHTFPAVLQSSGLYSLSSVVTVPSSSLGTKTYTCNVDHKPSNTKVDKRV ESKYGPPCPPCPAPEFLGGPSVFLFPPKPKDTLMISRTPEVTCVVVDVSQ EDPEVQFNWYVDGVEVHNAKTKPREEQFNSTYRVVSVLTVLHQDWLN GKEYKCKVSNKGLPSSIEKTISKAKGQPREPQVYTLPPSQEEMTKNQVS LTCLVKGFYPSDIAVEWESNGQPENNYKTTPPVLDSDGSFFLYSRLTVD KSRWQEGNVFSCSVMHEALHNHYTQKSLSLSLG |
| IgG1 wild type SEQ ID NO: 41 | HC | ASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKRV EPKSCDKTHTCPPCPAPELLGGPSVFLFPPKPKDTLMISRTPEVTCVVVD VSHEDPEVKFNWYVDGVEVHNAKTKPREEQYNSTYRVVSVLTVLHQD WLNGKEYKCKVSNKALPAPIEKTISKAKGQPREPQVYTLPPSREEMTKN QVSLTCLVKGFYPSDIAVEWESNGQPENNYKTTPPVLDSDGSFFLYSKL TVDKSRWQQGNVFSCSVMHEALHNHYTQKSLSLSPGK |
| IgG1 (N297A) mutant constant region (EU Numbering) SEQ ID NO: 42 | HC | ASTKGPSVFPLAPSSKSTSGGTAALGCLVKDYFPEPVTVSWNSGALTSG VHTFPAVLQSSGLYSLSSVVTVPSSSLGTQTYICNVNHKPSNTKVDKRV EPKSCDKTHTCPPCPAPELLGGPSVFLFPPKPKDTLMISRTPEVTCVVVD VSHEDPEVKFNWYVDGVEVHNAKTKPREEQYASTYRVVSVLTVLHQD WLNGKEYKCKVSNKALPAPIEKTISKAKGQPREPQVYTLPPSREEMTKN QVSLTCLVKGFYPSDIAVEWESNGQPENNYKTTPPVLDSDGSFFLYSKL TVDKSRWQQGNVFSCSVMHEALHNHYTQKSLSLSPGK |

B Cell, Macrophage & Dendritic Cell Engagers

Broadly, B cells, also known as B lymphocytes, are a type of white blood cell of the lymphocyte subtype. They function in the humoral immunity component of the adaptive immune system by secreting antibodies. Additionally, B cells present antigen (they are also classified as professional antigen-presenting cells (APCs)) and secrete cytokines. Macrophages are a type of white blood cell that engulfs and digests cellular debris, foreign substances, microbes, cancer cells via phagocytosis. Besides phagocytosis, they play important roles in nonspecific defense (innate immunity) and also help initiate specific defense mechanisms (adaptive immunity) by recruiting other immune cells such as lymphocytes. For example, they are important as antigen presenters to T cells. Beyond increasing inflammation and stimulating the immune system, macrophages also play an important anti-inflammatory role and can decrease immune reactions through the release of cytokines. Dendritic cells (DCs) are antigen-presenting cells that function in processing antigen material and present it on the cell surface to the T cells of the immune system.

The present disclosure provides, inter alia, multispecific (e.g., bi-, tri-, quad-specific) or multifunctional molecules, that include, e.g., are engineered to contain, one or more B cell, macrophage, and/or dendritic cell engager that mediate binding to and/or activation of a B cell, macrophage, and/or dendritic cell.

Accordingly, in some embodiments, the immune cell engager comprises a B cell, macrophage, and/or dendritic cell engager chosen from one or more of CD40 ligand (CD40L) or a CD70 ligand; an antibody molecule that binds to CD40 or CD70; an antibody molecule to OX40; an OX40 ligand (OX40L); an agonist of a Toll-like receptor (e.g., as described herein, e.g., a TLR4, e.g., a constitutively active TLR4 (caTLR4), or a TLR9 agonists); a 41BB; a CD2; a CD47; or a STING agonist, or a combination thereof.

In some embodiments, the B cell engager is a CD40L, an OX40L, or a CD70 ligand, or an antibody molecule that binds to OX40, CD40 or CD70.

In some embodiments, the macrophage engager is a CD2 agonist. In some embodiments, the macrophage engager is an antigen binding domain that binds to: CD40L or antigen binding domain or ligand that binds CD40, a Toll like receptor (TLR) agonist (e.g., as described herein), e.g., a TLR9 or TLR4 (e.g., caTLR4 (constitutively active TLR4), CD47, or a STING agonist. In some embodiments, the STING agonist is a cyclic dinucleotide, e.g., cyclic di-GMP (cdGMP) or cyclic di-AMP (cdAMP). In some embodiments, the STING agonist is biotinylated.

In some embodiments, the dendritic cell engager is a CD2 agonist. In some embodiments, the dendritic cell engager is a ligand, a receptor agonist, or an antibody molecule that binds to one or more of: OX40L, 41BB, a TLR agonist (e.g., as described herein) (e.g., TLR9 agonist, TLR4 (e.g., caTLR4 (constitutively active TLR4)), CD47, or and a STING agonist. In some embodiments, the STING agonist is a cyclic dinucleotide, e.g., cyclic di-GMP (cdGMP) or cyclic di-AMP (cdAMP). In some embodiments, the STING agonist is biotinylated.

In other embodiments, the immune cell engager mediates binding to, or activation of, one or more of a B cell, a macrophage, and/or a dendritic cell. Exemplary B cell, macrophage, and/or dendritic cell engagers can be chosen from one or more of CD40 ligand (CD40L) or a CD70 ligand; an antibody molecule that binds to CD40 or CD70; an antibody molecule to OX40; an OX40 ligand (OX40L); a Toll-like receptor agonist (e.g., a TLR4, e.g., a constitutively active TLR4 (caTLR4) or a TLR9 agonist); a 41BB agonist; a CD2; a CD47; or a STING agonist, or a combination thereof.

In some embodiments, the B cell engager is chosen from one or more of a CD40L, an OX40L, or a CD70 ligand, or an antibody molecule that binds to OX40, CD40 or CD70.

In other embodiments, the macrophage cell engager is chosen from one or more of a CD2 agonist; a CD40L; an OX40L; an antibody molecule that binds to OX40, CD40 or CD70; a Toll-like receptor agonist or a fragment thereof (e.g., a TLR4, e.g., a constitutively active TLR4 (caTLR4)); a CD47 agonist; or a STING agonist.

In other embodiments, the dendritic cell engager is chosen from one or more of a CD2 agonist, an OX40 antibody, an OX40L, 41BB agonist, a Toll-like receptor agonist or a fragment thereof (e.g., a TLR4, e.g., a constitutively active TLR4 (caTLR4)), CD47 agonist, or a STING agonist.

In one embodiment, the OX40L comprises the amino acid sequence: QVSHRYPRIQSIKVQFTEYKKEKGFLT-SQKEDEIMKVQNNSVIINCDGFYLISLKGYFSQ EVN-ISLHYQKDEEP-
LFQLKKVRSVNSLMVASLTYKDKVYLNVTTDNTSL DDFHVNGGE LILIHQNPGEFCVL (SEQ ID NO: 7245), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7245.

In another embodiment, the CD40L comprises the amino acid sequence: MQKGDQNPQIAAHVISEAS-SKTTSVLQWAEKGYYTMSNNLVT-
LENGKQLTVKRQGLY YIYAQVTFCSNREASSQAP-FIASLCLKSPGRFERILLRAANTHSSAKPCGQQSIHL GGVFE LQPGASVFVNVTDPSQVSHGTGFTSFGLLKL (SEQ ID NO: 7246), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7246.

In yet other embodiments, the STING agonist comprises a cyclic dinucleotide, e.g., a cyclic di-GMP (cdGMP), a cyclic di-AMP (cdAMP), or a combination thereof, optionally with 2',5' or 3',5' phosphate linkages.

In one embodiment, the immune cell engager includes 41BB ligand, e.g., comprising the amino acid sequence: ACPWAVSGARASPGSAASPRLREGPELSPDD-
PAGLLDLRQGMFAQLVAQNVLLIDGPL S WYSDPGLAGVSLTGGLSYKEDTKELVVAK-
AGVYYVFFQLELRRVVAGEGSGSVSLALH LQPLR-SAAGAAALALTVDLPPASSEARNSAFGFQGRLLHL-SAGQRLGVHLHTEARARH
AWQLTQGATVLGLFRVTPEIPAGLPSPRSE (SEQ ID NO: 7247), a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7247.

Toll-Like Receptors

Toll-Like Receptors (TLRs) are evolutionarily conserved receptors are homologues of the Drosophila Toll protein, and recognize highly conserved structural motifs known as pathogen-associated microbial patterns (PAMPs), which are exclusively expressed by microbial pathogens, or danger-associated molecular patterns (DAMPs) that are endogenous molecules released from necrotic or dying cells. PAMPs include various bacterial cell wall components such as lipopolysaccharide (LPS), peptidoglycan (PGN) and lipopeptides, as well as flagellin, bacterial DNA and viral double-stranded RNA. DAMPs include intracellular proteins such as heat shock proteins as well as protein fragments from the extracellular matrix. Stimulation of TLRs by the corresponding PAMPs or DAMPs initiates signaling cascades leading to the activation of transcription factors, such as AP-1, NF-κB and interferon regulatory factors (IRFs). Signaling by TLRs results in a variety of cellular responses, including the production of interferons (IFNs), pro-inflammatory cytokines and effector cytokines that direct the adaptive immune response. TLRs are implicated in a number of inflammatory and immune disorders and play a role in cancer (Rakoff-Nahoum S. & Medzhitov R., 2009. Toll-like receptors and cancer. Nat Revs Cancer 9:57-63.)

TLRs are type I transmembrane proteins characterized by an extracellular domain containing leucine-rich repeats (LRRs) and a cytoplasmic tail that contains a conserved region called the Toll/IL-1 receptor (TIR) domain. Ten human and twelve murine TLRs have been characterized, TLR1 to TLR10 in humans, and TLR1 to TLR9, TLR11, TLR12 and TLR13 in mice, the homolog of TLR10 being a pseudogene. TLR2 is essential for the recognition of a variety of PAMPs from Gram-positive bacteria, including bacterial lipoproteins, lipomannans and lipoteichoic acids. TLR3 is implicated in virus-derived double-stranded RNA. TLR4 is predominantly activated by lipopolysaccharide.

TLR5 detects bacterial flagellin and TLR9 is required for response to unmethylated CpG DNA. Finally, TLR7 and TLR8 recognize small synthetic antiviral molecules, and single-stranded RNA was reported to be their natural ligand. TLR11 has been reported to recognize uropathogenic *E. coli* and a profilin-like protein from *Toxoplasma gondii*. The repertoire of specificities of the TLRs is apparently extended by the ability of TLRs to heterodimerize with one another. For example, dimers of TLR2 and TLR6 are required for responses to diacylated lipoproteins while TLR2 and TLR1 interact to recognize triacylated lipoproteins. Specificities of the TLRs are also influenced by various adapter and accessory molecules, such as MD-2 and CD14 that form a complex with TLR4 in response to LPS.

TLR signaling consists of at least two distinct pathways: a MyD88-dependent pathway that leads to the production of inflammatory cytokines, and a MyD88-independent pathway associated with the stimulation of IFN-β and the maturation of dendritic cells. The MyD88-dependent pathway is common to all TLRs, except TLR3 (Adachi O. et al., 1998. Targeted disruption of the MyD88 gene results in loss of IL-1- and IL-18-mediated function. Immunity. 9(1):143-50). Upon activation by PAMPs or DAMPs, TLRs hetero- or homodimerize inducing the recruitment of adaptor proteins via the cytoplasmic TIR domain. Individual TLRs induce different signaling responses by usage of the different adaptor molecules. TLR4 and TLR2 signaling requires the adaptor TIRAP/Mal, which is involved in the MyD88-dependent pathway. TLR3 triggers the production of IFN-β in response to double-stranded RNA, in a MyD88-independent manner, through the adaptor TRIF/TICAM-1. TRAM/TICAM-2 is another adaptor molecule involved in the MyD88-independent pathway which function is restricted to the TLR4 pathway.

TLR3, TLR7, TLR8 and TLR9 recognize viral nucleic acids and induce type I IFNs. The signaling mechanisms leading to the induction of type I IFNs differ depending on the TLR activated. They involve the interferon regulatory factors, IRFs, a family of transcription factors known to play a critical role in antiviral defense, cell growth and immune regulation. Three IRFs (IRF3, TRF5 and IRF7) function as direct transducers of virus-mediated TLR signaling. TLR3 and TLR4 activate IRF3 and IRF7, while TLR7 and TLR8 activate IRF5 and IRF7 (Doyle S. et al., 2002. IRF3 mediates a TLR3/TLR4-specific antiviral gene program. Immunity. 17(3):251-63). Furthermore, type I IFN production stimulated by TLR9 ligand CpG-A has been shown to be mediated by PI(3)K and mTOR (Costa-Mattioli M. & Sonenberg N. 2008. RAPping production of type I interferon in pDCs through mTOR. Nature Immunol. 9: 1097-1099).

TLR-9

TLR9 recognizes unmethylated CpG sequences in DNA molecules. CpG sites are relatively rare (~1%) on vertebrate genomes in comparison to bacterial genomes or viral DNA. TLR9 is expressed by numerous cells of the immune system such as B lymphocytes, monocytes, natural killer (NK) cells, and plasmacytoid dendritic cells. TLR9 is expressed intracellularly, within the endosomal compartments and functions to alert the immune system of viral and bacterial infections by binding to DNA rich in CpG motifs. TLR9 signals leads to activation of the cells initiating pro-inflammatory reactions that result in the production of cytokines such as type-I interferon and IL-12.

TLR Agonists

A TLR agonist can agonize one or more TLR, e.g., one or more of human TLR-1, 2, 3, 4, 5, 6, 7, 8, 9, or 10. In some embodiments, an adjunctive agent described herein is a TLR agonist. In some embodiments, the TLR agonist specifically agonizes human TLR-9. In some embodiments, the TLR-9 agonist is a CpG moiety. As used herein, a CpG moiety, is a linear dinucleotide having the sequence: 5'-C-phosphate-G-3', that is, cytosine and guanine separated by only one phosphate.

In some embodiments, the CpG moiety comprises at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more CpG dinucleotides. In some embodiments, the CpG moiety consists of 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 CpG dinucleotides. In some embodiments, the CpG moiety has 1-5, 1-10, 1-20, 1-30, 1-40, 1-50, 5-10, 5-20, 5-30, 10-20, 10-30, 10-40, or 10-50 CpG dinucleotides.

In some embodiments, the TLR-9 agonist is a synthetic ODN (oligodeoxynucleotides). CpG ODNs are short synthetic single-stranded DNA molecules containing unmethylated CpG dinucleotides in particular sequence contexts (CpG motifs). CpG ODNs possess a partially or completely phosphorothioated (PS) backbone, as opposed to the natural phosphodiester (PO) backbone found in genomic bacterial DNA. There are three major classes of CpG ODNs: classes A, B and C, which differ in their immunostimulatory activities. CpG-A ODNs are characterized by a PO central CpG-containing palindromic motif and a PS-modified 3' poly-G string. They induce high IFN-α production from pDCs but are weak stimulators of TLR9-dependent NF-κB signaling and pro-inflammatory cytokine (e.g. IL-6) production. CpG-B ODNs contain a full PS backbone with one or more CpG dinucleotides. They strongly activate B cells and TLR9-dependent NF-κB signaling but weakly stimulate IFN-α secretion. CpG-C ODNs combine features of both classes A and B. They contain a complete PS backbone and a CpG-containing palindromic motif. C-Class CpG ODNs induce strong IFN-α production from pDC as well as B cell stimulation.

Stromal Modifying Moieties

Solid tumors have a distinct structure that mimics that of normal tissues and comprises two distinct but interdependent compartments: the parenchyma (neoplastic cells) and the stroma that the neoplastic cells induce and in which they are dispersed. All tumors have stroma and require stroma for nutritional support and for the removal of waste products. In the case of tumors which grow as cell suspensions (e.g., leukemias, ascites tumors), the blood plasma serves as stroma (Connolly J L et al. Tumor Structure and Tumor Stroma Generation. In: Kufe D W et al., editors. Holland-Frei *Cancer Medicine*. 6th edition. Hamilton: BC Decker; 2003). The stroma includes a variety of cell types, including fibroblasts/myofibroblasts, glial, epithelial, fat, vascular, smooth muscle, and immune cells along with extracellular matrix (ECM) and extracellular molecules (Li Hanchen et al. Tumor Microenvironment: The Role of the Tumor Stroma in Cancer. *J of Cellular Biochemistry* 101: 805-815 (2007)).

Stromal modifying moieties described herein include moieties (e.g., proteins, e.g., enzymes) capable of degrading a component of the stroma, e.g., an ECM component, e.g., a glycosaminoglycan, e.g., hyaluronan (also known as hyaluronic acid or HA), chondroitin sulfate, chondroitin, dermatan sulfate, heparin sulfate, heparin, entactin, tenascin, aggrecan and keratin sulfate; or an extracellular protein, e.g., collagen, laminin, elastin, fibrinogen, fibronectin, and vitronectin.

Stromal Modifying Enzymes

In some embodiments, the stromal modifying moiety is an enzyme. For example, the stromal modifying moiety can include, but is not limited to a hyaluronidase, a collagenase, a chondroitinase, a matrix metalloproteinase (e.g., macrophage metalloelastase).

Hyaluronidases

Hyaluronidases are a group of neutral- and acid-active enzymes found throughout the animal kingdom. Hyaluronidases vary with respect to substrate specificity, and mechanism of action. There are three general classes of hyaluronidases: (1) Mammalian-type hyaluronidases, (EC 3.2.1.35) which are endo-beta-N-acetylhexosaminidases with tetrasaccharides and hexasaccharides as the major end products. They have both hydrolytic and transglycosidase activities, and can degrade hyaluronan and chondroitin sulfates; (2) Bacterial hyaluronidases (EC 4.2.99.1) degrade hyaluronan and, and to various extents, chondroitin sulfate and dermatan sulfate. They are endo-beta-N-acetylhexosaminidases that operate by a beta elimination reaction that yields primarily disaccharide end products; (3) Hyaluronidases (EC 3.2.1.36) from leeches, other parasites, and crustaceans are endo-beta-glucuronidases that generate tetrasaccharide and hexasaccharide end products through hydrolysis of the beta 1-3 linkage.

Mammalian hyaluronidases can be further divided into two groups: (1) neutral active and (2) acid active enzymes. There are six hyaluronidase-like genes in the human genome, HYAL1, HYAL2, HYAL3 HYAL4 HYALP1 and PH20/SPAM1. HYALP1 is a pseudogene, and HYAL3 has not been shown to possess enzyme activity toward any known substrates. HYAL4 is a chondroitinase and lacks activity towards hyaluronan. HYAL1 is the prototypical acid-active enzyme and PH20 is the prototypical neutral-active enzyme. Acid active hyaluronidases, such as HYAL1 and HYAL2 lack catalytic activity at neutral pH. For example, HYAL1 has no catalytic activity in vitro over pH 4.5 (Frost and Stern, "A Microtiter-Based Assay for Hyaluronidase Activity Not Requiring Specialized Reagents", Analytical Biochemistry, vol. 251, pp. 263-269 (1997). HYAL2 is an acid active enzyme with a very low specific activity in vitro.

In some embodiments the hyaluronidase is a mammalian hyaluronidase. In some embodiments the hyaluronidase is a recombinant human hyaluronidase. In some embodiments, the hyaluronidase is a neutral active hyaluronidase. In some embodiments, the hyaluronidase is a neutral active soluble hyaluronidase. In some embodiments, the hyaluronidase is a recombinant PH20 neutral-active enzyme. In some embodiments, the hyaluronidase is a recombinant PH20 neutral-active soluble enzyme. In some embodiments the hyaluronidase is glycosylated. In some embodiments, the hyaluronidase possesses at least one N-linked glycan. A recombinant hyaluronidase can be produced using conventional methods known to those of skill in the art, e.g., U.S. Pat. No. 7,767,429, the entire contents of which are incorporated by reference herein.

In some embodiments the hyaluronidase is rHuPH20 (also referred to as Hylenex®; presently manufactured by Halozyme; approved by the FDA in 2005 (see e.g., Scodeller P (2014) Hyaluronidase and other Extracellular Matrix Degrading Enzymes for Cancer Therapy: New Uses and Nano-Formulations. *J Carcinog Mutage* 5:178; U.S. Pat. Nos. 7,767,429; 8,202,517; 7,431,380; 8,450,470; 8,772,246; 8,580,252, the entire contents of each of which is incorporated by reference herein). rHuPH20 is produced by genetically engineered CHO cells containing a DNA plasmid encoding for a soluble fragment of human hyaluronidase PH20. In some embodiments the hyaluronidase is glycosylated. In some embodiments, the hyaluronidase possesses at least one N-linked glycan. A recombinant hyaluronidase can be produced using conventional methods known to those of skill in the art, e.g., U.S. Pat. No. 7,767,429, the entire contents of which are incorporated by reference herein. In some embodiments, rHuPH20 has a sequence at least 95% (e.g., at least 96%, 97%, 98%, 99%, 100%) identical to the amino acid sequence of (SEQ ID NO: 7248)
LNFRAPPVIPNVPFLWAWNAPSEFCLGKFDEPLDMSLFSFIGSPRINATG

QGVTIFYVDRLGYYPYIDSITGVTVNGGIPQKISLQDHLDKAKKDITFYM

PVDNLGMAVIDWEEWRPTWARNWKPKDVYKNRSIELVQQQNVQLSLTEAT

EKAKQEFEKAGKDFLVETIKLGKLLRPNHLWGYYLFPDCYNHHYKKPGYN

GSCFNVEIKRNDDLSWLWNESTALYPSIYLNTQQSPVAATLYVRNRVREA

IRVSKIPDAKSPLPVFAYTRIVFTDQVLKFLSQDELVYTFGETVALGASG

IVIWGTLSIMRSMKSCLLLDNYMETILNPYIINVTLAAKMCSQVLCQEQG

VCIRKNWNSSDYLHLNPDNFAIQLEKGGKFTVRGKPTLEDLEQFSEKFYC

SCYSTLSCKEKADVKDTDAVDVCIADGVCIDAFLKPPMETEEPQIFYNAS

PSTLS.

In any of the methods provided herein, the anti-hyaluronan agent can be an agent that degrades hyaluronan or can be an agent that inhibits the synthesis of hyaluronan. For example, the anti-hyaluronan agent can be a hyaluronan degrading enzyme. In another example, the anti-hyaluronan agent or is an agent that inhibits hyaluronan synthesis. For example, the anti-hyaluronan agent is an agent that inhibits hyaluronan synthesis such as a sense or antisense nucleic acid molecule against an HA synthase or is a small molecule drug. For example, an anti-hyaluronan agent is 4-methylumbelliferone (MU) or a derivative thereof, or leflunomide or a derivative thereof. Such derivatives include, for example, a derivative of 4-methylumbelliferone (MU) that is 6,7-dihydroxy-4-methyl coumarin or 5,7-dihydroxy-4-methyl coumarin.

In further examples of the methods provided herein, the hyaluronan degrading enzyme is a hyaluronidase. In some examples, the hyaluronan-degrading enzyme is a PH20 hyaluronidase or truncated form thereof to lacking a C-terminal glycosylphosphatidylinositol (GPI) attachment site or a portion of the GPI attachment site. In specific examples, the hyaluronidase is a PH20 selected from a human, monkey, bovine, ovine, rat, mouse or guinea pig PH20. For example, the hyaluronan-degrading enzyme is a human PH20 hyaluronidase that is neutral active and N-glycosylated and is selected from among (a) a hyaluronidase polypeptide that is a full-length PH20 or is a C-terminal truncated form of the PH20, wherein the truncated form includes at least amino acid residues 36-464 of SEQ ID NO: 7248, such as 36-481, 36-482, 36-483, where the full-length PH20 has the sequence of amino acids set forth in SEQ ID NO: 7248; or (b) a hyaluronidase polypeptide comprising a sequence of amino acids having at least 85%, 86%, 87%, 88%, 89%, 90%, 91%, 92%, 93%, 94%, 95%, 96%, 97%, 98%, 99% or more sequence identity with the polypeptide or truncated form of sequence of amino acids set forth in SEQ ID NO: 7248; or (c) a hyaluronidase polypeptide of (a) or (b) comprising amino acid substitutions, whereby the hyaluronidase polypeptide has a sequence of amino acids having at least 85%, 86%, 87%, 88%, 89%, 90%, 91%, 92%, 93%, 94%, 95%, 96%, 97%, 98%, 99% or more sequence identity with the polypeptide set forth in SEQ ID NO: 7248 or the with the corresponding truncated forms thereof. In exemplary examples, the hyaluronan-degrading enzyme is a PH20 that comprises a composition designated rHuPH20.

In other examples, the anti-hyaluronan agent is a hyaluronan degrading enzyme that is modified by conjugation to a polymer. The polymer can be a PEG and the anti-hyaluronan agent a PEGylated hyaluronan degrading enzyme. Hence, in some examples of the methods provided herein the hyaluronan-degrading enzyme is modified by conjugation to a polymer. For example, the hyaluronan-degrading enzyme is conjugated to a PEG, thus the hyaluronan degrading enzyme is PEGylated. In an exemplary example, the hyaluronan-degrading enzyme is a PEGylated PH20 enzyme (PEGPH20). In the methods provided herein, the corticosteroid can be a glucocorticoid that is selected from among cortisones, dexamethasones, hydrocortisones, methylprednisolones, prednisolones and prednisones.

Chondroitinases

Chondroitinases are enzymes found throughout the animal kingdom which degrade glycosaminoglycans, specifically chondroitins and chondroitin sulfates, through an endoglycosidase reaction. In some embodiments the chondroitinase is a mammalian chondroitinase. In some embodiments the chondroitinase is a recombinant human chondroitinase. In some embodiments the chondroitinase is HYAL4. Other exemplary chondroitinases include chondroitinase ABC (derived from *Proteus vulgaris*; Japanese Patent Application Laid-open No 6-153947, T. Yamagata et al. J. Biol. Chem., 243, 1523 (1968), S. Suzuki et al, J. Biol. Chem., 243, 1543 (1968)), chondroitinase AC (derived from *Flavobacterium heparinum*; T. Yamagata et al., J. Biol. Chem., 243, 1523 (1968)), chondroitinase AC II (derived from *Arthrobacter aurescens*; K. Hiyama, and S. Okada, J. Biol. Chem., 250, 1824 (1975), K. Hiyama and S. Okada, J. Biochem. (Tokyo), 80, 1201 (1976)), Hyaluronidase ACIII (derived from *Flavobacterium* sp. Hp102; Hirofumi Miyazono et al., Seikagaku, 61, 1023 (1989)), chondroitinase B (derived from *Flavobacterium heparinum*; Y. M. Michelacci and C. P. Dietrich, Biochem. Biophys. Res. Commun., 56, 973 (1974), Y. M. Michelacci and C. P. Dietrich, Biochem. J., 151, 121 (1975), Kenichi Maeyama et al, Seikagaku, 57, 1189 (1985)), chondroitinase C (derived from *Flavobacterium* sp. Hp102; Hirofumi Miyazono et al, Seikagaku, 61, 1023 (1939)), and the like.

Matrix Metalloproteinases

Matrix metalloproteases (MMPs) are zinc-dependent endopeptidases that are the major proteases involved in extracellular matrix (ECM) degradation. MMPs are capable of degrading a wide range of extracellular molecules and a number of bioactive molecules. Twenty-four MMP genes have been identified in humans, which can be organized into six groups based on domain organization and substrate preference: Collagenases (MMP-1, -8 and -13), Gelatinases (MMP-2 and MMP-9), Stromelysins (MMP-3, -10 and -11), Matrilysin (MMP-7 and MMP-26), Membrane-type (MT)-MMPs (MMP-14, -15, -16, -17, -24 and -25) and others (MMP-12, -19, -20, -21, -23, -27 and -28). In some embodiments, the stromal modifying moiety is a human recombinant MMP (e.g., MMP-1, -2, -3, -4, -5, -6, -7, -8, -9, 10, -11, -12, -13, -14, 15, -15, -17, -18, -19, 20, -21, -22, -23, or -24).

Collagenases

The three mammalian collagenases (MMP-1, -8, and -13) are the principal secreted endopeptidases capable of cleaving collagenous extracellular matrix. In addition to fibrillar collagens, collagenases can cleave several other matrix and non-matrix proteins including growth factors. Collagenases are synthesized as inactive pro-forms, and once activated, their activity is inhibited by specific tissue inhibitors of metalloproteinases, TIMPs, as well as by non-specific proteinase inhibitors (Ala-aho R et al. *Biochimie. Collagenases in cancer.* 2005 March-April; 87(3-4):273-86). In some embodiments, the stromal modifying moiety is a collagenase. In some embodiments, the collagenase is a human recombinant collagenase. In some embodiments, the collagenase is MMP-1. In some embodiments, the collagenase is MMP-8. In some embodiments, the collagenase is MMP-13.

Macrophage Metalloelastase

Macrophage metalloelastase (MME), also known as MMP-12, is a member of the stromelysin subgroup of MMPs and catalyzes the hydrolysis of soluble and insoluble elastin and a broad selection of matrix and nonmatrix substrates including type IV collagen, fibronectin, laminin, vitronectin, entactin, heparan, and chondroitin sulfates (Erja Kerkela et al. Journal of Investigative Dermatology (2000) 114, 1113-1119; doi:10.1046/j.1523-1747.2000.00993). In some embodiments, the stromal modifying moiety is a MME. In some embodiments, the MME is a human recombinant MME. In some embodiments, the MME is MMP-12.

Additional Stromal Modifying Moieties

In some embodiments, the stromal modifying moiety causes one or more of: decreases the level or production of a stromal or extracellular matrix (ECM) component; decreases tumor fibrosis; increases interstitial tumor transport; improves tumor perfusion; expands the tumor microvasculature; decreases interstitial fluid pressure (IFP) in a tumor; or decreases or enhances penetration or diffusion of an agent, e.g., a cancer therapeutic or a cellular therapy, into a tumor or tumor vasculature.

In some embodiments, the stromal or ECM component decreased is chosen from a glycosaminoglycan or an extracellular protein, or a combination thereof. In some embodiments, the glycosaminoglycan is chosen from hyaluronan (also known as hyaluronic acid or HA), chondroitin sulfate, chondroitin, dermatan sulfate, heparin, heparin sulfate, entactin, tenascin, aggrecan and keratin sulfate. In some embodiments, the extracellular protein is chosen from collagen, laminin, elastin, fibrinogen, fibronectin, or vitronectin. In some embodiments, the stromal modifying moiety includes an enzyme molecule that degrades a tumor stroma or extracellular matrix (ECM). In some embodiments, the enzyme molecule is chosen from a hyaluronidase molecule, a collagenase molecule, a chondroitinase molecule, a matrix metalloproteinase molecule (e.g., macrophage metalloelastase), or a variant (e.g., a fragment) of any of the aforesaid. The term "enzyme molecule" includes a full length, a fragment or a variant of the enzyme, e.g., an enzyme variant that retains at least one functional property of the naturally-occurring enzyme.

In some embodiments, the stromal modifying moiety decreases the level or production of hyaluronic acid. In other embodiments, the stromal modifying moiety comprises a hyaluronan degrading enzyme, an agent that inhibits hyaluronan synthesis, or an antibody molecule against hyaluronic acid.

In some embodiments, the hyaluronan degrading enzyme is a hyaluronidase molecule, e.g., a full length or a variant (e.g., fragment thereof) thereof. In some embodiments, the hyaluronan degrading enzyme is active in neutral or acidic pH, e.g., pH of about 4-5. In some embodiments, the hyaluronidase molecule is a mammalian hyaluronidase molecule, e.g., a recombinant human hyaluronidase molecule, e.g., a full length or a variant (e.g., fragment thereof, e.g., a truncated form) thereof. In some embodiments, the hyaluronidase molecule is chosen from HYAL1, HYAL2, or PH-20/SPAM1, or a variant thereof (e.g., a truncated form thereof). In some embodiments, the truncated form lacks a C-terminal glycosylphosphatidylinositol (GPI) attachment site or a portion of the GPI attachment site. In some embodiments, the hyaluronidase molecule is glycosylated, e.g., comprises at least one N-linked glycan.

In some embodiments, the hyaluronidase molecule comprises the amino acid sequence: LNFRAPPVIPNVPFL-WAWNAPSEFCLGKFDEPLDMSLFSFIGSPRI-NATGQGVTIFYVDRL GYYPYIDSITGVTVNGGIPQKIS-LQDHLDKAKKDITFYMPVDNLGMAVIDWEE-WRPTW ARNWKPKDVYKNRSIELVQQQNVQLSL-TEATEKAKQEFEKAGKDFLVETIKLGKLLRP NHLWGYYLFPDCYNHHYKKPGYNGSCFN-VEIKRNDDLSWLWNESTALYPSIYLNTQQS PVAAT-LYVRNRVREAIRVSKIPDAKSPLPVFAY-TRIVFTDQVLKFLSQDELVYTFGETVA LGASGIVIWGTLSIMRSMKSCLLLDNYMETILNPYI-INVTLAAKMCSQVLCQEQGVCIRK NWNSSDYLHLNPDNFAIQLEKGGKFTVRGKP-TLEDLEQFSEKFYCSCYSTLSCKEKADV KDTDAVDV-CIADGVCIDAFLKPPMETEEPQIFYNASPSTLS (SEQ ID NO: 7256), or a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7256.

In some embodiments, the hyaluronidase molecule comprises:
  (i) the amino acid sequence of 36-464 of SEQ ID NO: 7256;
  (ii) the amino acid sequence of 36-481, 36-482, or 36-483 of PPH20, wherein PH20 has the sequence of amino acids set forth in SEQ ID NO: 7256; or
  (iii) an amino acid sequence having at least 95% to 100% sequence identity to the polypeptide or truncated form of sequence of amino acids set forth in SEQ ID NO: 7256; or
  (iv) an amino acid sequence having 30, 20, 10, 5 or fewer amino acid substitutions to the amino acid sequence set forth in SEQ ID NO: 7256. In some embodiments, the hyaluronidase molecule comprises an amino acid sequence at least 95% (e.g., at least 95%, 96%, 97%, 98%, 99%, 100%) identical to the amino acid sequence of SEQ ID NO: 7256. In some embodiments, the hyaluronidase molecule is encoded by a nucleotide sequence at least 95% (e.g., at least 96%, 97%, 98%, 99%, 100%) identical to the nucleotide sequence of SEQ ID NO: 7256.

In some embodiments, the hyaluronidase molecule is PH20, e.g., rHuPH20. In some embodiments, the hyaluronidase molecule is HYAL1 and comprises the amino acid sequence: FRGPLLPNRPFTTVWNANTQWCLER-HGVDVDVSVFDVVANPGQTFRGPDMTIFYSSQG TYPYYTPTGEPVFGGLPQNASLIAHLARTFQDILAAI-PAPDFSGLAVIDWEAWRPRWAFN WDTKDIYRQRSRALVQAQHPDWPAPQVEAV-AQDQFQGAARAWMAGTLQLGRALRPR GLWGFYGFPDCYNYDFLSPNYTGQCPSGI-RAQNDQLGWLWGQSRALYPSIYMPAVLEG TGKSQMYVQHRVAEAFRVAVAAGDPNLPVLPYVQI-FYDTTNHFLPLDELEHSLGESAA QGAAGVVLWVS-WENTRTKESCQAIKEYMDTTLGP-FILNVTSGALLCSQALCSGHGRCV RRTSHPKALLLLNPASFSIQLTPGGGPLSLR-GALSLEDQAQMAVEFKCRCYPGWQAPWC ERKSMW (SEQ ID NO: 7253), or a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7253.

In some embodiments, the hyaluronan degrading enzyme, e.g., the hyaluronidase molecule, further comprises a polymer, e.g., is conjugated to a polymer, e.g., PEG. In some embodiments, the hyaluronan-degrading enzyme is a PEGylated PH20 enzyme (PEGPH20). In some embodiments, the hyaluronan degrading enzyme, e.g., the hyaluronidase molecule, further comprises an immunoglobulin chain constant region (e.g., Fc region) chosen from, e.g., the heavy chain constant regions of IgG1, IgG2, IgG3, and IgG4, more particularly, the heavy chain constant region of human IgG1, IgG2, IgG3, or IgG4. In some embodiments, the immunoglobulin constant region (e.g., the Fc region) is linked, e.g., covalently linked to, the hyaluronan degrading enzyme, e.g., the hyaluronidase molecule. In some embodiments, the immunoglobulin chain constant region (e.g., Fc region) is altered, e.g., mutated, to increase or decrease one or more of: Fc receptor binding, antibody glycosylation, the number of cysteine residues, effector cell function, or complement function. In some embodiments, the hyaluronan degrading enzyme, e.g., the hyaluronidase molecule forms a dimer.

In some embodiments, the stromal modifying moiety comprises an inhibitor of the synthesis of hyaluronan, e.g., an HA synthase. In some embodiments, the inhibitor comprises a sense or an antisense nucleic acid molecule against an HA synthase or is a small molecule drug. In some embodiments, the inhibitor is 4-methylumbelliferone (MU) or a derivative thereof (e.g., 6,7-dihydroxy-4-methyl coumarin or 5,7-dihydroxy-4-methyl coumarin), or leflunomide or a derivative thereof.

In some embodiments, the stromal modifying moiety comprises antibody molecule against hyaluronic acid.

In some embodiments, the stromal modifying moiety comprises a collagenase molecule, e.g., a mammalian collagenase molecule, or a variant (e.g., fragment) thereof. In some embodiments, the collagenase molecule is collagenase molecule IV, e.g., comprising the amino acid sequence of: YNFFPRKPKWDKNQITYRIIGYTPDLDPETVDDA-FARAFQVWSDVTPLRFSRIHDGEADI MINFGR-WEHGDGYPFDGKDGLLAHA-FAPGTGVGGDSSHFDDDELWTLGEGQVVRVKY GNADGEYCKFPFLFNGKEYNSCTDTGRSDGFLWC-STTYNFEKDGKYGFCPHEALFTMG GNAEGQPCKFP-FRFQGTSYDSCTTEGRTDGYRWCGTTEDY-DRDKKYGFCPETAMSTVG GNSEGAPCVFPFTFLGNKYESCTSAGRSDGKMW-CATTANYDDDRKWGFCPDQGYSLF LVAA-HEFGHAMGLEHSQDPGALMAPIYTYTKNFRLSQD-DIKGIQELYGASPDIDLGTGP TPTLGPVTPEICKQDIVFDGIAQIRGE-IFFFKDRFIWRTVTPRDKPMGPLLVATFWPELPEK IDAVYEAPQEEKAVFFAGNEYWIYSASTLER-GYPKPLTSLGLPPDVQRVDAAFNWSKNK KTYIF-AGDKFWRYNEVKKKMDPGFPKLIADAWNAIPDNL-DAVVDLQGGGHSYFFKGA YYLKLENQSLKSVKFGSIKSDWLGC (SEQ ID NO: 7254), or a fragment thereof, or an amino acid sequence substantially identical thereto (e.g., 95% to 99.9% identical thereto, or having at least one amino acid alteration, but not more than five, ten or fifteen alterations (e.g., substitutions, deletions, or insertions, e.g., conservative substitutions) to the amino acid sequence of SEQ ID NO: 7254.

Linkers

The multispecific or multifunctional molecule disclosed herein can further include a linker, e.g., a linker between one or more of: the antigen binding domain and the cytokine molecule, the antigen binding domain and the immune cell engager, the antigen binding domain and the stromal modifying moiety, the cytokine molecule and the immune cell engager, the cytokine molecule and the stromal modifying moiety, the immune cell engager and the stromal modifying moiety, the antigen binding domain and the immunoglobulin chain constant region, the cytokine molecule and the immunoglobulin chain constant region, the immune cell engager and the immunoglobulin chain constant region, or the stromal modifying moiety and the immunoglobulin chain constant region. In embodiments, the linker is chosen from: a cleavable linker, a non-cleavable linker, a peptide linker, a flexible linker, a rigid linker, a helical linker, or a non-helical linker, or a combination thereof.

In one embodiment, the multispecific molecule can include one, two, three or four linkers, e.g., a peptide linker. In one embodiment, the peptide linker includes Gly and Ser. In some embodiments, the peptide linker is selected from GGGGS (SEQ ID NO: 7249); GGGGSGGGGS (SEQ ID NO: 7250); GGGGSGGGGSGGGGS (SEQ ID NO: 7251); and DVPSGPGGGGSGGGGS (SEQ ID NO: 7252). In some embodiments, the peptide linker is a A(EAAAK)nA (SEQ ID NO: 7255) family of linkers (e.g., as described in Protein Eng. (2001) 14 (8): 529-532). These are stiff helical linkers with n ranging from 2-5. In some embodiments, the peptide linker is selected from AEAAAKEAAAKAAA (SEQ ID NO: 75); AEAAAKEAAAKEAAAKAAA (SEQ ID NO: 76); AEAAAKEAAAKEAAAKEAAAKAAA (SEQ ID NO: 77); and AEAAAKEAAAKEAAAKEAAAKEAAAKAAA (SEQ ID NO: 78).

Nucleic Acids

Nucleic acids encoding the aforementioned multispecific or multifunctional molecules are also disclosed.

In certain embodiments, the invention features nucleic acids comprising nucleotide sequences that encode heavy and light chain variable regions and CDRs or hypervariable loops of the antibody molecules, as described herein. For example, the invention features a first and second nucleic acid encoding heavy and light chain variable regions, respectively, of an antibody molecule chosen from one or more of the antibody molecules disclosed herein. The nucleic acid can comprise a nucleotide sequence as set forth in the tables herein, or a sequence substantially identical thereto (e.g., a sequence at least about 85%, 90%, 95%, 99% or more identical thereto, or which differs by no more than 3, 6, 15, 30, or 45 nucleotides from the sequences shown in the tables herein.

In certain embodiments, the nucleic acid can comprise a nucleotide sequence encoding at least one, two, or three CDRs or hypervariable loops from a heavy chain variable region having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions). In other embodiments, the nucleic acid can comprise a nucleotide sequence encoding at least one, two, or three CDRs or hypervariable loops from a light chain variable region having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions). In yet another embodiment, the nucleic acid can comprise a nucleotide sequence encoding at least one, two, three, four, five, or six CDRs or hypervariable loops from heavy and light chain variable regions having an amino acid sequence as set forth in the tables herein, or a sequence substantially homologous thereto (e.g., a sequence at least about 85%, 90%, 95%, 99% or more identical thereto, and/or having one or more substitutions, e.g., conserved substitutions).

In certain embodiments, the nucleic acid can comprise a nucleotide sequence encoding at least one, two, or three CDRs or hypervariable loops from a heavy chain variable region having the nucleotide sequence as set forth in the tables herein, a sequence substantially homologous thereto (e.g., a sequence at least about 85%, 90%, 95%, 99% or more identical thereto, and/or capable of hybridizing under the stringency conditions described herein). In another embodiment, the nucleic acid can comprise a nucleotide sequence encoding at least one, two, or three CDRs or hypervariable loops from a light chain variable region having the nucleotide sequence as set forth in the tables herein, or a sequence substantially homologous thereto (e.g., a sequence at least about 85%, 90%, 95%, 99% or more identical thereto, and/or capable of hybridizing under the stringency conditions described herein). In yet another embodiment, the nucleic acid can comprise a nucleotide sequence encoding at least one, two, three, four, five, or six CDRs or hypervariable loops from heavy and light chain variable regions having the nucleotide sequence as set forth in the tables herein, or a sequence substantially homologous thereto (e.g., a sequence at least about 85%, 90%, 95%, 99% or more identical thereto, and/or capable of hybridizing under the stringency conditions described herein).

In certain embodiments, the nucleic acid can comprise a nucleotide sequence encoding a cytokine molecule, an immune cell engager, or a stromal modifying moiety disclosed herein.

In another aspect, the application features host cells and vectors containing the nucleic acids described herein. The nucleic acids may be present in a single vector or separate vectors present in the same host cell or separate host cell, as described in more detail hereinbelow.

Vectors

Further provided herein are vectors comprising the nucleotide sequences encoding a multispecific or multifunctional molecule described herein. In one embodiment, the vectors comprise nucleotides encoding a multispecific or multifunctional molecule described herein. In one embodiment, the vectors comprise the nucleotide sequences described herein. The vectors include, but are not limited to, a virus, plasmid, cosmid, lambda phage or a yeast artificial chromosome (YAC).

Numerous vector systems can be employed. For example, one class of vectors utilizes DNA elements which are derived from animal viruses such as, for example, bovine papilloma virus, polyoma virus, adenovirus, vaccinia virus, baculovirus, retroviruses (Rous Sarcoma Virus, MMTV or MOMLV) or SV40 virus. Another class of vectors utilizes RNA elements derived from RNA viruses such as Semliki Forest virus, Eastern Equine Encephalitis virus and Flaviviruses.

Additionally, cells which have stably integrated the DNA into their chromosomes may be selected by introducing one or more markers which allow for the selection of transfected host cells. The marker may provide, for example, prototropy to an auxotrophic host, biocide resistance (e.g., antibiotics), or resistance to heavy metals such as copper, or the like. The selectable marker gene can be either directly linked to the DNA sequences to be expressed, or introduced into the same cell by cotransformation. Additional elements may also be needed for optimal synthesis of mRNA. These elements may include splice signals, as well as transcriptional promoters, enhancers, and termination signals.

Once the expression vector or DNA sequence containing the constructs has been prepared for expression, the expression vectors may be transfected or introduced into an appropriate host cell. Various techniques may be employed to achieve this, such as, for example, protoplast fusion, calcium phosphate precipitation, electroporation, retroviral transduction, viral transfection, gene gun, lipid based transfection or other conventional techniques. In the case of protoplast fusion, the cells are grown in media and screened for the appropriate activity.

Methods and conditions for culturing the resulting transfected cells and for recovering the antibody molecule produced are known to those skilled in the art, and may be varied or optimized depending upon the specific expression vector and mammalian host cell employed, based upon the present description.

Cells

In another aspect, the application features host cells and vectors containing the nucleic acids described herein. The nucleic acids may be present in a single vector or separate vectors present in the same host cell or separate host cell. The host cell can be a eukaryotic cell, e.g., a mammalian cell, an insect cell, a yeast cell, or a prokaryotic cell, e.g., *E. coli*. For example, the mammalian cell can be a cultured cell or a cell line. Exemplary mammalian cells include lymphocytic cell lines (e.g., NSO), Chinese hamster ovary cells (CHO), COS cells, oocyte cells, and cells from a transgenic animal, e.g., mammary epithelial cell.

The invention also provides host cells comprising a nucleic acid encoding an antibody molecule as described herein.

In one embodiment, the host cells are genetically engineered to comprise nucleic acids encoding the antibody molecule.

In one embodiment, the host cells are genetically engineered by using an expression cassette. The phrase "expression cassette," refers to nucleotide sequences, which are capable of affecting expression of a gene in hosts compatible with such sequences. Such cassettes may include a promoter, an open reading frame with or without introns, and a termination signal. Additional factors necessary or helpful in effecting expression may also be used, such as, for example, an inducible promoter.

The invention also provides host cells comprising the vectors described herein.

The cell can be, but is not limited to, a eukaryotic cell, a bacterial cell, an insect cell, or a human cell. Suitable eukaryotic cells include, but are not limited to, Vero cells, HeLa cells, COS cells, CHO cells, HEK293 cells, BHK cells and MDCKII cells. Suitable insect cells include, but are not limited to, Sf9 cells.

Uses and Combination Therapies

Methods described herein include treating a cancer in a subject by using a multispecific molecule described herein, e.g., using a pharmaceutical composition described herein. Also provided are methods for reducing or ameliorating a symptom of a cancer in a subject, as well as methods for inhibiting the growth of a cancer and/or killing one or more cancer cells. In embodiments, the methods described herein decrease the size of a tumor and/or decrease the number of cancer cells in a subject administered with a described herein or a pharmaceutical composition described herein.

In embodiments, the cancer is a hematological cancer. In embodiments, the hematological cancer is a leukemia or a lymphoma. As used herein, a "hematologic cancer" refers to a tumor of the hematopoietic or lymphoid tissues, e.g., a tumor that affects blood, bone marrow, or lymph nodes. Exemplary hematologic malignancies include, but are not limited to, leukemia (e.g., acute lymphoblastic leukemia (ALL), acute myeloid leukemia (AML), chronic lymphocytic leukemia (CLL), chronic myelogenous leukemia (CML), hairy cell leukemia, acute monocytic leukemia (AMoL), chronic myelomonocytic leukemia (CMML), juvenile myelomonocytic leukemia (JMML), or large granular lymphocytic leukemia), lymphoma (e.g., AIDS-related lymphoma, cutaneous T-cell lymphoma, Hodgkin lymphoma (e.g., classical Hodgkin lymphoma or nodular lymphocyte-predominant Hodgkin lymphoma), mycosis fungoides, non-Hodgkin lymphoma (e.g., B-cell non-Hodgkin lymphoma (e.g., Burkitt lymphoma, small lymphocytic lymphoma (CLL/SLL), diffuse large B-cell lymphoma, follicular lymphoma, immunoblastic large cell lymphoma, precursor B-lymphoblastic lymphoma, or mantle cell lymphoma) or T-cell non-Hodgkin lymphoma (mycosis fungoides, anaplastic large cell lymphoma, or precursor T-lymphoblastic lymphoma)), primary central nervous system lymphoma, Sézary syndrome, Waldenstrom macroglobulinemia), chronic myeloproliferative neoplasm, Langerhans cell histiocytosis, multiple myeloma/plasma cell neoplasm, myelodysplastic syndrome, or myelodysplastic/myeloproliferative neoplasm.

In embodiments, the cancer is a solid cancer. Exemplary solid cancers include, but are not limited to, ovarian cancer, rectal cancer, stomach cancer, testicular cancer, cancer of the anal region, uterine cancer, colon cancer, rectal cancer, renal-cell carcinoma, liver cancer, non-small cell carcinoma of the lung, cancer of the small intestine, cancer of the esophagus, melanoma, Kaposi's sarcoma, cancer of the endocrine system, cancer of the thyroid gland, cancer of the parathyroid gland, cancer of the adrenal gland, bone cancer, pancreatic cancer, skin cancer, cancer of the head or neck, cutaneous or intraocular malignant melanoma, uterine cancer, brain stem glioma, pituitary adenoma, epidermoid cancer, carcinoma of the cervix squamous cell cancer, carcinoma of the fallopian tubes, carcinoma of the endometrium, carcinoma of the vagina, sarcoma of soft tissue, cancer of the urethra, carcinoma of the vulva, cancer of the penis, cancer of the bladder, cancer of the kidney or ureter, carcinoma of the renal pelvis, spinal axis tumor, neoplasm of the central nervous system (CNS), primary CNS lymphoma, tumor angiogenesis, metastatic lesions of said cancers, or combinations thereof.

In certain embodiments, the cancer is an epithelial, mesenchymal or hematologic malignancy. In certain embodiments, the cancer treated is a solid tumor (e.g., carcinoid, carcinoma or sarcoma), a soft tissue tumor (e.g., a heme malignancy), and a metastatic lesion, e.g., a metastatic lesion of any of the cancers disclosed herein. In one embodiment, the cancer treated is a fibrotic or desmoplastic solid tumor, e.g., a tumor having one or more of: limited tumor perfusion, compressed blood vessels, fibrotic tumor interstitium, or increased interstitial fluid pressure. In one embodiment, the solid tumor is chosen from one or more of pancreatic (e.g., pancreatic adenocarcinoma or pancreatic ductal adenocarcinoma), breast, colon, colorectal, lung (e.g., small cell lung cancer (SCLC) or non-small cell lung cancer (NSCLC)), skin, ovarian, liver cancer, esophageal cancer, endometrial cancer, gastric cancer, head and neck cancer, kidney, or prostate cancer.

Examples of cancer include, but are not limited to, carcinoma, lymphoma, blastoma, sarcoma, and leukemia or lymphoid malignancies. More particular examples of such cancers are noted below and include: squamous cell cancer (e.g. epithelial squamous cell cancer), lung cancer including small-cell lung cancer, non-small cell lung cancer, adenocarcinoma of the lung and squamous carcinoma of the lung, cancer of the peritoneum, hepatocellular cancer, gastric or stomach cancer including gastrointestinal cancer, pancreatic cancer, glioblastoma, cervical cancer, ovarian cancer, liver cancer, bladder cancer, hepatoma, breast cancer, colon cancer, rectal cancer, colorectal cancer, endometrial cancer or uterine carcinoma, salivary gland carcinoma, kidney or renal cancer, prostate cancer, vulval cancer, thyroid cancer, hepatic carcinoma, anal carcinoma, penile carcinoma, as well as head and neck cancer. The term "cancer" includes primary malignant cells or tumors (e.g., those whose cells have not migrated to sites in the subject's body other than the site of the original malignancy or tumor) and secondary malignant cells or tumors (e.g., those arising from metastasis, the migration of malignant cells or tumor cells to secondary sites that are different from the site of the original tumor).

Other examples of cancers or malignancies include, but are not limited to: Acute Childhood Lymphoblastic Leukemia, Acute Lymphoblastic Leukemia, Acute Lymphocytic Leukemia, Acute Myeloid Leukemia, Adrenocortical Carcinoma, Adult (Primary) Hepatocellular Cancer, Adult (Primary) Liver Cancer, Adult Acute Lymphocytic Leukemia, Adult Acute Myeloid Leukemia, Adult Hodgkin's Disease, Adult Hodgkin's Lymphoma, Adult Lymphocytic Leukemia, Adult Non-Hodgkin's Lymphoma, Adult Primary Liver Cancer, Adult Soft Tissue Sarcoma, AIDS-Related Lymphoma, AIDS-Related Malignancies, Anal Cancer, Astrocytoma, Bile Duct Cancer, Bladder Cancer, Bone Cancer, Brain Stem Glioma, Brain Tumors, Breast Cancer, Cancer of the Renal Pelvis and Ureter, Central Nervous System (Primary) Lymphoma, Central Nervous System Lymphoma, Cerebellar Astrocytoma, Cerebral Astrocytoma, Cervical Cancer, Childhood (Primary) Hepatocellular Cancer, Childhood (Primary) Liver Cancer, Childhood Acute Lymphoblastic Leukemia, Childhood Acute Myeloid Leukemia, Childhood Brain Stem Glioma, Childhood Cerebellar Astrocytoma, Childhood Cerebral Astrocytoma, Childhood Extracranial Germ Cell Tumors, Childhood Hodgkin's Disease, Childhood Hodgkin's Lymphoma, Childhood Hypothalamic and Visual Pathway Glioma, Childhood Lymphoblastic Leukemia, Childhood Medulloblastoma, Childhood Non-Hodgkin's Lymphoma, Childhood Pineal and Supratentorial Primitive Neuroectodermal Tumors, Childhood Primary Liver Cancer, Childhood Rhabdomyosarcoma, Childhood Soft Tissue Sarcoma, Childhood Visual Pathway and Hypothalamic Glioma, Chronic Lymphocytic Leukemia, Chronic Myelogenous Leukemia, Colon Cancer, Cutaneous T-Cell Lymphoma, Endocrine Pancreas Islet Cell Carcinoma, Endometrial Cancer, Ependymoma, Epithelial Cancer, Esophageal Cancer, Ewing's Sarcoma and Related Tumors, Exocrine Pancreatic Cancer, Extracranial Germ Cell Tumor, Extragonadal Germ Cell Tumor, Extrahepatic Bile Duct Cancer, Eye Cancer, Female Breast Cancer, Gaucher's Disease, Gallbladder Cancer, Gastric Cancer, Gastrointestinal Carcinoid Tumor, Gastrointestinal Tumors, Germ Cell Tumors, Gestational Trophoblastic Tumor, Hairy Cell Leukemia, Head and Neck Cancer, Hepatocellular Cancer, Hodgkin's Disease, Hodgkin's Lymphoma, Hypergammaglobulinemia, Hypopharyngeal Cancer, Intestinal Cancers, Intraocular Melanoma, Islet Cell Carcinoma, Islet Cell Pancreatic Cancer, Kaposi's Sarcoma, Kidney Cancer, Laryngeal Cancer, Lip and Oral Cavity Cancer, Liver Cancer, Lung Cancer, Lymphoproliferative Disorders, Macroglobulinemia, Male Breast Cancer, Malignant Mesothelioma, Malignant Thymoma, Medulloblastoma, Melanoma, Mesothelioma, Metastatic Occult Primary Squamous Neck Cancer, Metastatic Primary Squamous Neck Cancer, Metastatic Squamous Neck Cancer, Multiple Myeloma, Multiple Myeloma/Plasma Cell Neoplasm, Myelodysplastic Syndrome, Myelogenous Leukemia, Myeloid Leukemia, Myeloproliferative Disorders, Nasal Cavity and Paranasal Sinus Cancer, Nasopharyngeal Cancer, Neuroblastoma, Non-Hodgkin's Lymphoma During Pregnancy, Nonmelanoma Skin Cancer, Non-Small Cell Lung Cancer, Occult Primary Metastatic Squamous Neck Cancer, Oropharyngeal Cancer, Osteo-/Malignant Fibrous Sarcoma, Osteosarcoma/ Malignant Fibrous Histiocytoma, Osteosarcoma/Malignant Fibrous Histiocytoma of Bone, Ovarian Epithelial Cancer, Ovarian Germ Cell Tumor, Ovarian Low Malignant Potential Tumor, Pancreatic Cancer, Paraproteinemias, Purpura, Parathyroid Cancer, Penile Cancer, Pheochromocytoma, Pituitary Tumor, Plasma Cell Neoplasm/Multiple Myeloma, Primary Central Nervous System Lymphoma, Primary Liver Cancer, Prostate Cancer, Rectal Cancer, Renal Cell Cancer, Renal Pelvis and Ureter Cancer, Retinoblastoma, Rhabdomyosarcoma, Salivary Gland Cancer, Sarcoidosis Sarcomas, Sezary Syndrome, Skin Cancer, Small Cell Lung Cancer, Small Intestine Cancer, Soft Tissue Sarcoma, Squamous Neck Cancer, Stomach Cancer, Supratentorial Primitive Neuroectodermal and Pineal Tumors, T-Cell Lymphoma, Testicular Cancer, Thymoma, Thyroid Cancer, Transitional Cell Cancer of the Renal Pelvis and Ureter, Transitional Renal Pelvis and Ureter Cancer, Trophoblastic Tumors, Ureter and Renal Pelvis Cell Cancer, Urethral Cancer, Uterine Cancer, Uterine Sarcoma, Vaginal Cancer, Visual Pathway and Hypothalamic Glioma, Vulvar Cancer, Waldenstrom's Macroglobulinemia, Wilms' Tumor, and any other hyperproliferative disease, besides neoplasia, located in an organ system listed above.

In other embodiments, the multispecific molecule, as described above and herein, is used to treat a hyperproliferative disorder, e.g., a hyperproliferative connective tissue disorder (e.g., a hyperproliferative fibrotic disease). In one embodiment, the hyperproliferative fibrotic disease is multisystemic or organ-specific. Exemplary hyperproliferative fibrotic diseases include, but are not limited to, multisystemic (e.g., systemic sclerosis, multifocal fibrosclerosis, sclerodermatous graft-versus-host disease in bone marrow transplant recipients, nephrogenic systemic fibrosis, scleroderma), and organ-specific disorders (e.g., fibrosis of the eye, lung, liver, heart, kidney, pancreas, skin and other organs). In other embodiments, the disorder is chosen from liver cirrhosis or tuberculosis. In other embodiments, the disorder is leprosy.

In embodiments, the multispecific molecules (or pharmaceutical composition) are administered in a manner appropriate to the disease to be treated or prevented. The quantity and frequency of administration will be determined by such factors as the condition of the patient, and the type and severity of the patient's disease. Appropriate dosages may be determined by clinical trials. For example, when "an effective amount" or "a therapeutic amount" is indicated, the precise amount of the pharmaceutical composition (or multispecific molecules) to be administered can be determined by a physician with consideration of individual differences in tumor size, extent of infection or metastasis, age, weight, and condition of the subject. In embodiments, the pharmaceutical composition described herein can be administered at a dosage of $10^4$ to $10^9$ cells/kg body weight, e.g., $10^5$ to $10^6$ cells/kg body weight, including all integer values within those ranges. In embodiments, the pharmaceutical composition described herein can be administered multiple times at these dosages. In embodiments, the pharmaceutical composition described herein can be administered using infusion techniques described in immunotherapy (see, e.g., Rosenberg et al., New Eng. J. of Med. 319:1676, 1988).

In embodiments, the cancer is a myeloproliferative neoplasm, e.g., primary or idiopathic myelofibrosis (MF), essential thrombocytosis (ET), polycythemia vera (PV), or chronic myelogenous leukemia (CML). In embodiments, the cancer is myelofibrosis. In embodiments, the subject has myelofibrosis. In embodiments, the subject has a calreticulin mutation, e.g., a calreticulin mutation disclosed herein. In embodiments, the subject does not have the JAK2-V617F mutation. In embodiments, the subject has the JAK2-V617F mutation. In embodiments, the subject has a MPL mutation. In embodiments, the subject does not have a MPL mutation.

In embodiments, the cancer is a solid cancer. Exemplary solid cancers include, but are not limited to, ovarian cancer, rectal cancer, stomach cancer, testicular cancer, cancer of the anal region, uterine cancer, colon cancer, rectal cancer, renal-cell carcinoma, liver cancer, non-small cell carcinoma of the lung, cancer of the small intestine, cancer of the esophagus, melanoma, Kaposi's sarcoma, cancer of the endocrine system, cancer of the thyroid gland, cancer of the parathyroid gland, cancer of the adrenal gland, bone cancer, pancreatic cancer, skin cancer, cancer of the head or neck, cutaneous or intraocular malignant melanoma, uterine cancer, brain stem glioma, pituitary adenoma, epidermoid cancer, carcinoma of the cervix squamous cell cancer, carcinoma of the fallopian tubes, carcinoma of the endometrium, carcinoma of the vagina, sarcoma of soft tissue, cancer of the urethra, carcinoma of the vulva, cancer of the penis, cancer of the bladder, cancer of the kidney or ureter, carcinoma of the renal pelvis, spinal axis tumor, neoplasm of the central nervous system (CNS), primary CNS lymphoma, tumor angiogenesis, metastatic lesions of said cancers, or combinations thereof.

In embodiments, the multispecific molecules or pharmaceutical composition is administered to the subject parenterally. In embodiments, the cells are administered to the subject intravenously, subcutaneously, intratumorally, intranodally, intramuscularly, intradermally, or intraperitoneally. In embodiments, the cells are administered, e.g., injected, directly into a tumor or lymph node. In embodiments, the cells are administered as an infusion (e.g., as described in Rosenberg et al., New Eng. J. of Med. 319: 1676, 1988) or an intravenous push. In embodiments, the cells are administered as an injectable depot formulation.

In embodiments, the subject is a mammal. In embodiments, the subject is a human, monkey, pig, dog, cat, cow, sheep, goat, rabbit, rat, or mouse. In embodiments, the subject is a human. In embodiments, the subject is a pediatric subject, e.g., less than 18 years of age, e.g., less than 17, 16, 15, 14, 13, 12, 11, 10, 9, 8, 7, 6, 5, 4, 3, 2, 1 or less years of age. In embodiments, the subject is an adult, e.g., at least 18 years of age, e.g., at least 19, 20, 21, 22, 23, 24, 25, 25-30, 30-35, 35-40, 40-50, 50-60, 60-70, 70-80, or 80-90 years of age.

Combination Therapies

The multispecific or multifunctional molecules disclosed herein can be used in combination with a second therapeutic agent or procedure.

In embodiments, the multispecific or multifunctional molecule and the second therapeutic agent or procedure are administered/performed after a subject has been diagnosed with a cancer, e.g., before the cancer has been eliminated from the subject. In embodiments, the multispecific or multifunctional molecule and the second therapeutic agent or procedure are administered/performed simultaneously or concurrently. For example, the delivery of one treatment is still occurring when the delivery of the second commences, e.g., there is an overlap in administration of the treatments. In other embodiments, the multispecific or multifunctional molecule and the second therapeutic agent or procedure are administered/performed sequentially. For example, the delivery of one treatment ceases before the delivery of the other treatment begins.

In embodiments, combination therapy can lead to more effective treatment than monotherapy with either agent alone. In embodiments, the combination of the first and second treatment is more effective (e.g., leads to a greater reduction in symptoms and/or cancer cells) than the first or second treatment alone. In embodiments, the combination therapy permits use of a lower dose of the first or the second treatment compared to the dose of the first or second treatment normally required to achieve similar effects when administered as a monotherapy. In embodiments, the combination therapy has a partially additive effect, wholly additive effect, or greater than additive effect.

In one embodiment, the multispecific or multifunctional molecule is administered in combination with a therapy, e.g., a cancer therapy (e.g., one or more of anti-cancer agents, immunotherapy, photodynamic therapy (PDT), surgery and/or radiation). The terms "chemotherapeutic," "chemotherapeutic agent," and "anti-cancer agent" are used interchangeably herein. The administration of the multispecific or multifunctional molecule and the therapy, e.g., the cancer therapy, can be sequential (with or without overlap) or simultaneous. Administration of the multispecific or multifunctional molecule can be continuous or intermittent during the course of therapy (e.g., cancer therapy). Certain therapies described herein can be used to treat cancers and non-cancerous diseases. For example, PDT efficacy can be enhanced in cancerous and non-cancerous conditions (e.g., tuberculosis) using the methods and compositions described herein (reviewed in, e.g., Agostinis, P. et al. (2011) *CA Cancer J. Clin.* 61:250-281).

Anti-Cancer Therapies

In other embodiments, the multispecific or multifunctional molecule is administered in combination with a low or small molecular weight chemotherapeutic agent. Exemplary low or small molecular weight chemotherapeutic agents include, but not limited to, 13-cis-retinoic acid (isotretinoin, ACCUTANE®), 2-CdA (2-chlorodeoxyadenosine, cladribine, LEUSTATIN™), 5-azacitidine (azacitidine, VIDAZA®), 5-fluorouracil (5-FU, fluorouracil, ADRUCIL®), 6-mercaptopurine (6-MP, mercaptopurine, PURINETHOL®), 6-TG (6-thioguanine, thioguanine, THIOGUANINE TABLOID®), abraxane (paclitaxel protein-bound), actinomycin-D (dactinomycin, COSMEGEN®), alitretinoin (PANRETIN®), all-transretinoic acid (ATRA, tretinoin, VESANOID®), altretamine (hexamethylmelamine, HMM, HEXALEN®), amethopterin (methotrexate, methotrexate sodium, MTX, TREXALL™, RHEUMATREX®), amifostine (ETHYOL®), arabinosylcytosine (Ara-C, cytarabine, CYTOSAR-U®), arsenic trioxide (TRISENOX®), asparaginase (Erwinia L-asparaginase, L-asparaginase, ELSPAR®, KIDROLASE®), BCNU (carmustine, BiCNU®), bendamustine (TREANDA®), bexarotene (TARGRETIN®), bleomycin (BLENOXANE®), busulfan (BUSULFEX®, MYLERAN®), calcium leucovorin (Citrovorum Factor, folinic acid, leucovorin), camptothecin-11 (CPT-11, irinotecan, CAMPTOSAR®), capecitabine (XELODA®), carboplatin (PARAPLATIN®), carmustine wafer (prolifeprospan 20 with carmustine implant, GLIADEL® wafer), CCI-779 (temsirolimus, TORISEL®), CCNU (lomustine, CeeNU), CDDP (cisplatin, PLATINOL®, PLATINOL-AQ®), chlorambucil (leukeran), cyclophosphamide (CYTOXAN®, NEOSAR®), dacarbazine (DIC, DTIC, imidazole carboxamide, DTIC-DOME®), daunomycin (daunorubicin, daunorubicin hydrochloride, rubidomycin hydrochloride, CERUBIDINE®), decitabine (DACOGEN®), dexrazoxane (ZINECARD®), DHAD (mitoxantrone, NOVANTRONE®), docetaxel (TAXOTERE®), doxorubicin (ADRIAMYCIN®, RUBEX®), epirubicin (ELLENCE™), estramustine (EMCYT®), etoposide (VP-16, etoposide phosphate, TOPOSAR®, VEPESID®, ETOPOPHOS®), floxuridine (FUDR®), fludarabine (FLUDARA®), fluorouracil (cream) (CARAC™, EFUDEX®, FLUOROPLEX®), gemcitabine (GEMZAR®), hydroxyurea (HYDREA®, DROXIA™, MYLOCEL™), idarubicin (IDAMYCIN®), ifosfamide (IFEX®), ixabepilone (IXEMPRA™), LCR (leurocristine, vincristine, VCR, ONCOVIN®, VINCASAR PFS®), L-PAM (L-sarcolysin, melphalan, phenylalanine mustard, ALKERAN®), mechlorethamine (mechlorethamine hydrochloride, mustine, nitrogen mustard, MUSTARGEN®), mesna (MESNEX™), mitomycin (mitomycin-C, MTC, MUTAMYCIN®), nelarabine (ARRANON®), oxaliplatin (ELOXATIN™), paclitaxel (TAXOL®, ONXAL™), pegaspargase (PEG-L-asparaginase, ONCOSPAR®), PEMETREXED (ALIMTA®), pentostatin (NIPENT®), procarbazine (MATULANE®), streptozocin (ZANOSAR®), temozolomide (TEMODAR®), teniposide (VM-26, VUMON®), TESPA (thiophosphoamide, thiotepa, TSPA, THIOPLEX®), topotecan (HYCAMTIN®), vinblastine (vinblastine sulfate, vincaleukoblastine, VLB, ALKABAN-AQ®, VELBAN®), vinorelbine (vinorelbine tartrate, NAVELBINE®), and vorinostat (ZOLINZA®).

In another embodiment, the multispecific or multifunctional molecule is administered in conjunction with a biologic. Biologics useful in the treatment of cancers are known in the art and a binding molecule of the invention may be administered, for example, in conjunction with such known biologics. For example, the FDA has approved the following biologics for the treatment of breast cancer: HERCEPTIN® (trastuzumab, Genentech Inc., South San Francisco, Calif.; a humanized monoclonal antibody that has anti-tumor activity in HER2-positive breast cancer); FASLODEX® (fulvestrant, AstraZeneca Pharmaceuticals, LP, Wilmington, Del.; an estrogen-receptor antagonist used to treat breast cancer); ARIMIDEX® (anastrozole, AstraZeneca Pharmaceuticals, LP; a nonsteroidal aromatase inhibitor which blocks aromatase, an enzyme needed to make estrogen); Aromasin® (exemestane, Pfizer Inc., New York, N.Y.; an irreversible, steroidal aromatase inactivator used in the treatment of breast cancer); FEMARA® (letrozole, Novartis Pharmaceuticals, East Hanover, N.J.; a nonsteroidal aromatase inhibitor approved by the FDA to treat breast cancer); and NOLVADEX® (tamoxifen, AstraZeneca Pharmaceuticals, LP; a nonsteroidal antiestrogen approved by the FDA to treat breast cancer). Other biologics with which the binding molecules of the invention may be combined include: AVASTIN® (bevacizumab, Genentech Inc.; the first FDA-approved therapy designed to inhibit angiogenesis); and ZEVALIN® (ibritumomab tiuxetan, Biogen Idec, Cambridge, Mass.; a radiolabeled monoclonal antibody currently approved for the treatment of B-cell lymphomas).

In addition, the FDA has approved the following biologics for the treatment of colorectal cancer: AVASTIN®; ERBITUX® (cetuximab, ImClone Systems Inc., New York, N.Y., and Bristol-Myers Squibb, New York, N.Y.; is a monoclonal antibody directed against the epidermal growth factor receptor (EGFR)); GLEEVEC® (imatinib mesylate; a protein kinase inhibitor); and ERGAMISOL® (levamisole hydrochloride, Janssen Pharmaceutica Products, LP, Titusville, N.J.; an immunomodulator approved by the FDA in 1990 as an adjuvant treatment in combination with 5-fluorouracil after surgical resection in patients with Dukes' Stage C colon cancer).

For the treatment of lung cancer, exemplary biologics include TARCEVA® (erlotinib HCL, OSI Pharmaceuticals Inc., Melville, N.Y.; a small molecule designed to target the human epidermal growth factor receptor 1 (HER1) pathway).

For the treatment of multiple myeloma, exemplary biologics include VELCADE® Velcade (bortezomib, Millennium Pharmaceuticals, Cambridge Mass.; a proteasome inhibitor). Additional biologics include THALIDOMID® (thalidomide, Clegene Corporation, Warren, N.J.; an immunomodulatory agent and appears to have multiple actions, including the ability to inhibit the growth and survival of myeloma cells and anti-angiogenesis).

Additional exemplary cancer therapeutic antibodies include, but are not limited to, 3F8, abagovomab, adecatumumab, afutuzumab, alacizumab pegol, alemtuzumab (CAMPATH®, MABCAMPATH®), altumomab pentetate (HYBRI-CEAKER®), anatumomab mafenatox, anrukinzumab (IMA-638), apolizumab, arcitumomab (CEA-SCAN®), bavituximab, bectumomab (LYMPHOSCAN®), belimumab (BENLYSTA®, LYMPHOSTAT-B®), besilesomab (SCINTIMUN®), bevacizumab (AVASTIN®), bivatuzumab mertansine, blinatumomab, brentuximab vedotin, cantuzumab mertansine, capromab pendetide (PROSTASCINT®), catumaxomab (REMOVAB®), CC49, cetuximab (C225, ERBITUX®), citatuzumab bogatox, cixutumumab, clivatuzumab tetraxetan, conatumumab, dacetuzumab, denosumab (PROLIA®), detumomab, ecromeximab, edrecolomab (PANOREX®), elotuzumab, epitumomab cituxetan, epratuzumab, ertumaxomab (REXOMUN®), etaracizumab, farletuzumab, figitumumab, fresolimumab, galiximab, gemtuzumab ozogamicin (MYLOTARG®), girentuximab, glembatumumab vedotin, ibritumomab (ibritumomab tiuxetan, ZEVALIN®), igovomab (INDIMACIS-125®), intetumumab, inotuzumab ozogamicin, ipilimumab, iratumumab, labetuzumab (CEA-CIDE®), lexatumumab, lintuzumab, lucatumumab, lumiliximab, mapatumumab, matuzumab, milatuzumab, minretumomab, mitumomab, nacolomab tafenatox, naptumomab estafenatox, necitumumab, nimotuzumab (THERACIM®, THERALOC®), nofetumomab merpentan (VERLUMA®), ofatumumab (ARZERRA®), olaratumab, oportuzumab monatox, oregovomab (OVAREX®), panitumumab (VECTIBIX®), pemtumomab (THERAGYN®), pertuzumab (OMNITARG®), pintumomab, pritumumab, ramucirumab, ranibizumab (LUCENTIS®), rilotumumab, rituximab (MABTHERA®, RITUXAN®), robatumumab, satumomab pendetide, sibrotuzumab, siltuximab, sontuzumab, tacatuzumab tetraxetan (AFP-CIDE®), taplitumomab paptox, tenatumomab, TGN1412, ticilimumab (tremelimumab), tigatuzumab, TNX-650, tositumomab (BEXXAR®), trastuzumab (HERCEPTIN®), tremelimumab, tucotuzumab celmoleukin, veltuzumab, volociximab, votumumab (HUMASPECT®), zalutumumab (HUMAX-EGFR®), and zanolimumab (HUMAX-CD4®).

In other embodiments, the multispecific or multifunctional molecule is administered in combination with a viral cancer therapeutic agent. Exemplary viral cancer therapeutic agents include, but not limited to, vaccinia virus (vvDD-CDSR), carcinoembryonic antigen-expressing measles virus, recombinant vaccinia virus (TK-deletion plus GM-CSF), Seneca Valley virus-001, Newcastle virus, coxsackie virus A21, GL-ONC1, EBNA1 C-terminal/LMP2 chimeric protein-expressing recombinant modified vaccinia Ankara vaccine, carcinoembryonic antigen-expressing measles virus, G207 oncolytic virus, modified vaccinia virus Ankara vaccine expressing p53, OncoVEX GM-CSF modified herpes-simplex 1 virus, fowlpox virus vaccine vector, recombinant vaccinia prostate-specific antigen vaccine, human papillomavirus 16/18 L1 virus-like particle/ASO4 vaccine, MVA-EBNA1/LMP2 Inj. vaccine, quadrivalent HPV vaccine, quadrivalent human papillomavirus (types 6, 11, 16, 18) recombinant vaccine (GARDASIL®), recombinant fowlpox-CEA(6D)/TRICOM vaccine; recombinant vaccinia-CEA(6D)-TRICOM vaccine, recombinant modified vaccinia Ankara-5T4 vaccine, recombinant fowlpox-TRICOM vaccine, oncolytic herpes virus NV1020, HPV L1 VLP vaccine V504, human papillomavirus bivalent (types 16 and 18) vaccine (CERVARIX®), herpes simplex virus HF10, Ad5CMV-p53 gene, recombinant vaccinia DF3/MUC1 vaccine, recombinant vaccinia-MUC-1 vaccine, recombinant vaccinia-TRICOM vaccine, ALVAC MART-1 vaccine, replication-defective herpes simplex virus type I (HSV-1) vector expressing human Preproenkephalin (NP2), wild-type reovirus, reovirus type 3 Dearing (REOLYSIN®), oncolytic virus HSV1716, recombinant modified vaccinia Ankara (MVA)-based vaccine encoding Epstein-Barr virus target antigens, recombinant fowlpox-prostate specific antigen vaccine, recombinant vaccinia prostate-specific antigen vaccine, recombinant vaccinia-B7.1 vaccine, rAd-p53 gene, Ad5-delta24RGD, HPV vaccine 580299, JX-594 (thymidine kinase-deleted vaccinia virus plus GM-CSF), HPV-16/18 L1/ASO4, fowlpox virus vaccine vector, vaccinia-tyrosinase vaccine, MEDI-517 HPV-16/18 VLP ASO4 vaccine, adenoviral vector containing the thymidine kinase of herpes simplex virus TK99UN, HspE7, FP253/Fludarabine, ALVAC(2) melanoma multi-antigen therapeutic vaccine, ALVAC-hB7.1, canarypox-hIL-12 melanoma vaccine, Ad-REIC/Dkk-3, rAd-IFN SCH 721015, TIL-Ad-INFg, Ad-ISF35, and coxsackievirus A21 (CVA21, CAVATAK®).

In other embodiments, the multispecific or multifunctional molecule is administered in combination with a nanopharmaceutical. Exemplary cancer nanopharmaceuticals include, but not limited to, ABRAXANE® (paclitaxel bound albumin nanoparticles), CRLX101 (CPT conjugated to a linear cyclodextrin-based polymer), CRLX288 (conjugating docetaxel to the biodegradable polymer poly (lactic-co-glycolic acid)), cytarabine liposomal (liposomal Ara-C, DEPOCYT™), daunorubicin liposomal (DAUNOXOME®), doxorubicin liposomal (DOXIL®, CAELYX®), encapsulated-daunorubicin citrate liposome (DAUNOXOME®), and PEG anti-VEGF aptamer (MACUGEN®).

In some embodiments, the multispecific or multifunctional molecule is administered in combination with paclitaxel or a paclitaxel formulation, e.g., TAXOL®, protein-bound paclitaxel (e.g., ABRAXANE®). Exemplary paclitaxel formulations include, but are not limited to, nanoparticle albumin-bound paclitaxel (ABRAXANE®, marketed by Abraxis Bioscience), docosahexaenoic acid bound-paclitaxel (DHA-paclitaxel, Taxoprexin, marketed by Protarga), polyglutamate bound-paclitaxel (PG-paclitaxel, paclitaxel poliglumex, CT-2103, XYOTAX, marketed by Cell Therapeutic), the tumor-activated prodrug (TAP), ANG105 (Angiopep-2 bound to three molecules of paclitaxel, marketed by ImmunoGen), paclitaxel-EC-1 (paclitaxel bound to the erbB2-recognizing peptide EC-1; see Li et al., *Biopolymers* (2007) 87:225-230), and glucose-conjugated paclitaxel (e.g., 2'-paclitaxel methyl 2-glucopyranosyl succinate, see Liu et al., *Bioorganic & Medicinal Chemistry Letters* (2007) 17:617-620).

Exemplary RNAi and antisense RNA agents for treating cancer include, but not limited to, CALAA-01, siG12D LODER (Local Drug EluteR), and ALN-VSP02.

Other cancer therapeutic agents include, but not limited to, cytokines (e.g., aldesleukin (IL-2, Interleukin-2, PROLEUKIN®), alpha Interferon (IFN-alpha, Interferon alfa, INTRON® A (Interferon alfa-2b), ROFERON-A® (Interferon alfa-2a)), Epoetin alfa (PROCRIT®), filgrastim (G-CSF, Granulocyte-Colony Stimulating Factor, NEUPOGEN®), GM-CSF (Granulocyte Macrophage Colony Stimulating Factor, sargramostim, LEUKINE™), IL-11 (Interleukin-11, oprelvekin, NEUMEGA®), Interferon alfa-2b (PEG conjugate) (PEG interferon, PEG-INTRON™), and pegfilgrastim (NEULASTA™)), hormone therapy agents (e.g., aminoglutethimide (CYTADREN®), anastrozole (ARIMIDEX®), bicalutamide (CASODEX®), exemestane (AROMASIN®), fluoxymesterone (HALOTESTIN®), flutamide (EULEXIN®), fulvestrant (FASLODEX®), goserelin (ZOLADEX®), letrozole (FEMARA®), leuprolide (ELIGARD™, LUPRON®, LUPRON DEPOT®, VIADUR™), megestrol (megestrol acetate, MEGACE®), nilutamide (ANANDRON®, NILANDRON®), octreotide (octreotide acetate, SANDOSTATIN®, SANDOSTATIN LAR®), raloxifene (EVISTA®), romiplostim (NPLATE®), tamoxifen (NOVALDEX®), and toremifene (FARESTON®)), phospholipase A2 inhibitors (e.g., anagrelide (AGRYLIN®)), biologic response modifiers (e.g., BCG (THERACYS®, TICE®), and Darbepoetin alfa (ARANESP®)), target therapy agents (e.g., bortezomib (VELCADE®), dasatinib (SPRYCEL™), denileukin diftitox (ONTAK®), erlotinib (TARCEVA®), everolimus (AFINITOR®), gefitinib (IRESSA®), imatinib mesylate (STI-571, GLEEVEC™), lapatinib (TYKERB®), sorafenib (NEXAVAR®), and SU11248 (sunitinib, SUTENT®)), immunomodulatory and antiangiogenic agents (e.g., CC-5013 (lenalidomide, REVLIMID®), and thalidomide (THALOMID®)), glucocorticosteroids (e.g., cortisone (hydrocortisone, hydrocortisone sodium phosphate, hydrocortisone sodium succinate, ALA-CORT®, HYDROCORT ACETATE®, hydrocortone phosphate LANACORT®, SOLU-CORTEF®), decadron (dexamethasone, dexamethasone acetate, dexamethasone sodium phosphate, DEXASONE®, DIODEX®, HEXADROL®, MAXIDEX®), methylprednisolone (6-methylprednisolone, methylprednisolone acetate, methylprednisolone sodium succinate, DURALONE®, MEDRALONE®, MEDROL®, M-PREDNISOL®, SOLU-MEDROL®), prednisolone (DELTA-CORTEF®, ORAPRED®, PEDIAPRED®, PRELONE®), and prednisone (DELTASONE®, LIQUID PRED®, METICORTEN®, ORASONE®)), and bisphosphonates (e.g., pamidronate (AREDIA®), and zoledronic acid (ZOMETA®))

In some embodiments, the multispecific or multifunctional molecule is used in combination with a tyrosine kinase inhibitor (e.g., a receptor tyrosine kinase (RTK) inhibitor). Exemplary tyrosine kinase inhibitor include, but are not limited to, an epidermal growth factor (EGF) pathway inhibitor (e.g., an epidermal growth factor receptor (EGFR) inhibitor), a vascular endothelial growth factor (VEGF) pathway inhibitor (e.g., an antibody against VEGF, a VEGF trap, a vascular endothelial growth factor receptor (VEGFR) inhibitor (e.g., a VEGFR-1 inhibitor, a VEGFR-2 inhibitor, a VEGFR-3 inhibitor)), a platelet derived growth factor (PDGF) pathway inhibitor (e.g., a platelet derived growth factor receptor (PDGFR) inhibitor (e.g., a PDGFR-8 inhibitor)), a RAF-1 inhibitor, a KIT inhibitor and a RET inhibitor. In some embodiments, the anti-cancer agent used in combination with the AHCM agent is selected from the group consisting of: axitinib (AG013736), bosutinib (SKI-606), cediranib (RECENTIN™, AZD2171), dasatinib (SPRYCEL®, BMS-354825), erlotinib (TARCEVA®), gefitinib (IRESSA®), imatinib (Gleevec®, CGP57148B, STI-571), lapatinib (TYKERB®, TYVERB®), lestaurtinib (CEP-701), neratinib (HKI-272), nilotinib (TASIGNA®), semaxanib (semaxinib, SU5416), sunitinib (SUTENT®, SU11248), toceranib (PALLADIA®), vandetanib (ZACTIMA®, ZD6474), vatalanib (PTK787, PTK/ZK), trastuzumab (HERCEPTIN®), bevacizumab (AVASTIN®), rituximab (RITUXAN®), cetuximab (ERBITUX®), panitumumab (VECTIBIX®), ranibizumab (Lucentis®), nilotinib (TASIGNA®), sorafenib (NEXAVAR®), alemtuzumab (CAMPATH®), gemtuzumab ozogamicin (MYLOTARG®), ENMD-2076, PCI-32765, AC220, dovitinib lactate (TK1258, CHIR-258), BIBW 2992 (TOVOK™), SGX523, PF-04217903, PF-02341066, PF-299804, BMS-777607, ABT-869, MP470, BIBF 1120 (VARGATEF®), AP24534, JNJ-26483327, MGCD265, DCC-2036, BMS-690154, CEP-11981, tivozanib (AV-951), OSI-930, MM-121, XL-184, XL-647, XL228, AEE788, AG-490, AST-6, BMS-599626, CUDC-101, PD153035, pelitinib (EKB-569), vandetanib (zactima), WZ3146, WZ4002, WZ8040, ABT-869 (linifanib), AEE788, AP24534 (ponatinib), AV-951 (tivozanib), axitinib, BAY 73-4506 (regorafenib), brivanib alaninate (BMS-582664), brivanib (BMS-540215), cediranib (AZD2171), CHIR-258 (dovitinib), CP 673451, CYC116, E7080, Ki8751, masitinib (AB1010), MGCD-265, motesanib diphosphate (AMG-706), MP-470, OSI-930, Pazopanib Hydrochloride, PD173074, Sorafenib Tosylate (Bay 43-9006), SU 5402, TSU-68 (SU6668), vatalanib, XL880 (GSK1363089, EXEL-2880). Selected tyrosine kinase inhibitors are chosen from sunitinib, erlotinib, gefitinib, or sorafenib. In one embodiment, the tyrosine kinase inhibitor is sunitinib.

In one embodiment, the multispecific or multifunctional molecule is administered in combination with one of more of: an anti-angiogenic agent, or a vascular targeting agent or a vascular disrupting agent. Exemplary anti-angiogenic agents include, but are not limited to, VEGF inhibitors (e.g., anti-VEGF antibodies (e.g., bevacizumab); VEGF receptor inhibitors (e.g., itraconazole); inhibitors of cell proliferatin and/or migration of endothelial cells (e.g., carboxyamidotriazole, TNP-470); inhibitors of angiogenesis stimulators (e.g., suramin), among others. A vascular-targeting agent (VTA) or vascular disrupting agent (VDA) is designed to damage the vasculature (blood vessels) of cancer tumors causing central necrosis (reviewed in, e.g., Thorpe, P. E. (2004) Clin. Cancer Res. Vol. 10:415-427). VTAs can be small-molecule. Exemplary small-molecule VTAs include, but are not limited to, microtubule destabilizing drugs (e.g., combretastatin A-4 disodium phosphate (CA4P), ZD6126, AVE8062, Oxi 4503); and vadimezan (ASA404).

Immune Checkpoint Inhibitors

In other embodiments, methods described herein comprise use of an immune checkpoint inhibitor in combination with the multispecific or multifunctional molecule. The methods can be used in a therapeutic protocol in vivo.

In embodiments, an immune checkpoint inhibitor inhibits a checkpoint molecule. Exemplary checkpoint molecules include but are not limited to CTLA4, PD1, PD-L1, PD-L2, TIM3, LAG3, CD160, 2B4, CD80, CD86, B7-H3 (CD276), B7-H4 (VTCN1), HVEM (TNFRSF14 or CD270), BTLA, KIR, MHC class I, MHC class II, GAL9, VISTA, BTLA, TIGIT, LAIR1, and A2aR. See, e.g., Pardoll. Nat. Rev. Cancer 12.4(2012):252-64, incorporated herein by reference.

In embodiments, the immune checkpoint inhibitor is a PD-1 inhibitor, e.g., an anti-PD-1 antibody such as Nivolumab, Pembrolizumab or Pidilizumab. Nivolumab (also called MDX-1106, MDX-1106-04, ONO-4538, or BMS-936558) is a fully human IgG4 monoclonal antibody that specifically inhibits PD1. See, e.g., U.S. Pat. No. 8,008,449 and WO2006/121168. Pembrolizumab (also called Lambrolizumab, MK-3475, MK03475, SCH-900475 or KEYTRUDA®; Merck) is a humanized IgG4 monoclonal antibody that binds to PD-1. See, e.g., Hamid, O. et al. (2013) New England Journal of Medicine 369 (2): 134-44, U.S. Pat. No. 8,354,509 and WO2009/114335. Pidilizumab (also called CT-011 or Cure Tech) is a humanized IgG1k monoclonal antibody that binds to PD1. See, e.g., WO2009/101611. In one embodiment, the inhibitor of PD-1 is an antibody molecule having a sequence substantially identical or similar thereto, e.g., a sequence at least 85%, 90%, 95% identical or higher to the sequence of Nivolumab, Pembrolizumab or Pidilizumab. Additional anti-PD1 antibodies, e.g., AMP 514 (Amplimmune), are described, e.g., in U.S. Pat. No. 8,609,089, US 2010028330, and/or US 20120114649.

In some embodiments, the PD-1 inhibitor is an immunoadhesin, e.g., an immunoadhesin comprising an extracellular/PD-1 binding portion of a PD-1 ligand (e.g., PD-L1 or PD-L2) that is fused to a constant region (e.g., an Fc region of an immunoglobulin). In embodiments, the PD-1 inhibitor is AMP-224 (B7-DCIg, e.g., described in WO2011/066342 and WO2010/027827), a PD-L2 Fc fusion soluble receptor that blocks the interaction between B7-H1 and PD-1.

In embodiments, the immune checkpoint inhibitor is a PD-L1 inhibitor, e.g., an antibody molecule. In some embodiments, the PD-L1 inhibitor is YW243.55.570, MPDL3280A, MEDI-4736, MSB-0010718C, or MDX-1105. In some embodiments, the anti-PD-L1 antibody is MSB0010718C (also called A09-246-2; Merck Serono), which is a monoclonal antibody that binds to PD-L1. Exemplary humanized anti-PD-L1 antibodies are described, e.g., in WO2013/079174. In one embodiment, the PD-L1 inhibitor is an anti-PD-L1 antibody, e.g., YW243.55.570. The YW243.55.570 antibody is described, e.g., in WO 2010/077634. In one embodiment, the PD-L1 inhibitor is MDX-1105 (also called BMS-936559), which is described, e.g., in WO2007/005874. In one embodiment, the PD-L1 inhibitor is MDPL3280A (Genentech/Roche), which is a human Fc-optimized IgG1 monoclonal antibody against PD-L1. See, e.g., U.S. Pat. No. 7,943,743 and U.S Publication No.: 20120039906. In one embodiment, the inhibitor of PD-L1 is an antibody molecule having a sequence substantially identical or similar thereto, e.g., a sequence at least 85%, 90%, 95% identical or higher to the sequence of YW243.55.S70, MPDL3280A, MEDI-4736, MSB-0010718C, or MDX-1105.

In embodiments, the immune checkpoint inhibitor is a PD-L2 inhibitor, e.g., AMP-224 (which is a PD-L2 Fc fusion soluble receptor that blocks the interaction between PD1 and B7-H1. See, e.g., WO2010/027827 and WO2011/066342.

In one embodiment, the immune checkpoint inhibitor is a LAG-3 inhibitor, e.g., an anti LAG-3 antibody molecule. In embodiments, the anti-LAG-3 antibody is BMS-986016 (also called BMS986016; Bristol-Myers Squibb). BMS-986016 and other humanized anti-LAG-3 antibodies are described, e.g., in US 2011/0150892, WO2010/019570, and WO2014/008218.

In embodiments, the immune checkpoint inhibitor is a TIM-3 inhibitor, e.g., anti-TIM3 antibody molecule, e.g., described in U.S. Pat. No. 8,552,156, WO 2011/155607, EP 2581113 and U.S Publication No.: 2014/044728.

In embodiments, the immune checkpoint inhibitor is a CTLA-4 inhibitor, e.g., anti-CTLA-4 antibody molecule. Exemplary anti-CTLA4 antibodies include Tremelimumab (IgG2 monoclonal antibody from Pfizer, formerly known as ticilimumab, CP-675,206); and Ipilimumab (also called MDX-010, CAS No. 477202-00-9). Other exemplary anti-CTLA-4 antibodies are described, e.g., in U.S. Pat. No. 5,811,097.

INCORPORATION BY REFERENCE

All publications and patents mentioned herein are hereby incorporated by reference in their entirety as if each individual publication or patent was specifically and individually indicated to be incorporated by reference.

EXAMPLES

Example 1: Immunization of Armenian Hamster to Generate Anti-NKp30 Antibodies

Briefly, armenian hamster were immunized with the extracellular domain of human NKp30 protein in complete Freund's adjuvant and boosted twice on day 14 and day 28 with NKp30 in incomplete Freund's adjuvant (IFA). On day 56 one more boost in IFA was given and the animals harvested three days later. Spleens were collected and fused with P3X63Ag8.653 murine myeloma cell line. 0.9×10^5 cells/well in 125 ul were seated in 96 well plate and feed with 125 μl of I-20+2ME+HAT (IMDM (4 g/L glucose) supplemented with 20% fetal bovine serum, 4 mM L-glutamine, 1 mM sodium pyruvate, 50 U penicillin, 50 μg streptomycin and 50 μM 2-ME in the absence or presence of HAT or HT for selection, and Hybridoma Cloning Factor (1% final) on days 7, 11 and thereafter as needed. At approximately 2 weeks after fusion (cells are about 50% confluent) supernatant was collected and assayed for binding.

Example 2: Hybridoma Screen for NKp30 mAbs

Expi293 cells were transfected with BG160 (hNKp30 cell antigen) 18 hours prior to screening. The day of screening, transfected cells were diluted to 0.05×10^6/mL and anti-Armenian hamster Fc Alexa Fluor 488 added to a final concentration of 0.4 ug/mL. 50 uL (2,500 cells) of this mixture was added to each well of a 384 well plate. The same density of untransfected 293 cells with secondary were used as a negative control. 5 uL of hybridoma supernatant was added to the cell mixture and the plate incubated for 1 hour at 37° C. The plates were then imaged on Mirrorball. Positive clones were identified and subcloned by serial dilution to obtain clonal selected hybridoma. After reconfirmation using the same protocols the hybridoma cells were harvested and the corresponding heavy and light chain sequences recovered. The DNA was subcloned into pcDNA3.4 for subsequent expression of the corresponding antibodies and further validation.

Example 3: Binding of NKp30 Antibodies to NK92 Cells

Figure 9:
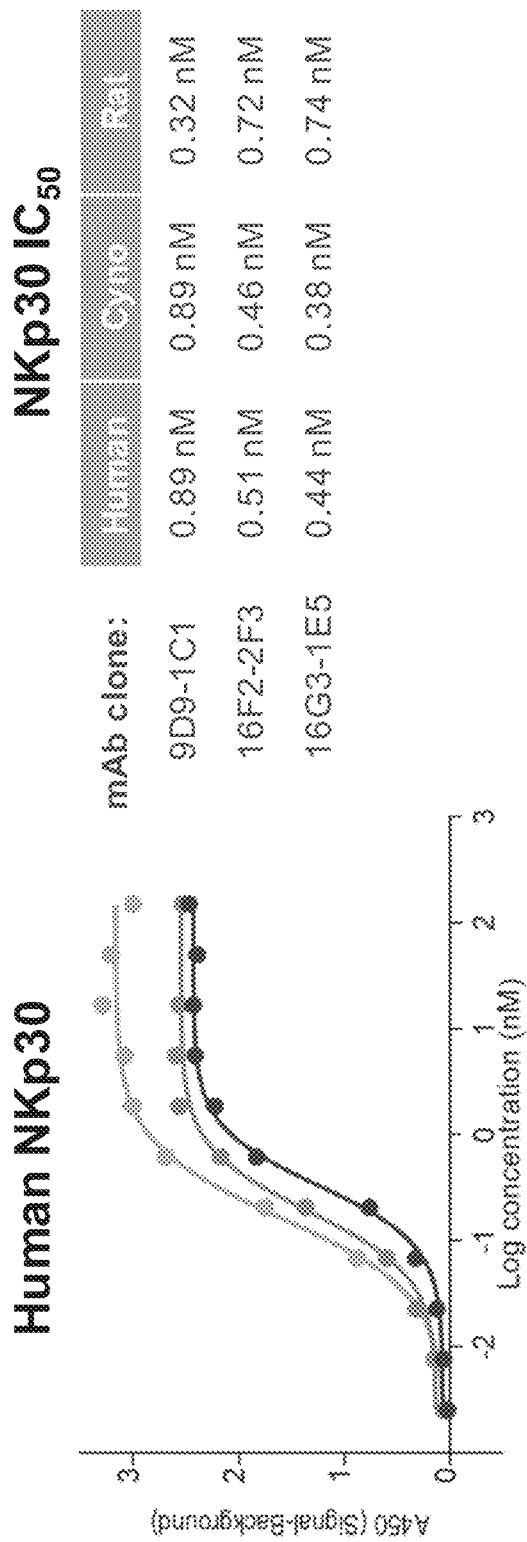
FIG. 9 is a graph showing binding of NKp30 antibodies to NK92 cells. Data was calculated as the percent-AF747 positive population.

NK-92 cells were washed with PBS containing 0.5% BSA and 0.1% sodium azide (staining buffer) and added to 96-well V-bottom plates with 200,000 cells/well. Hamster NKp30 antibodies were added to the cells in 2.0 fold serial dilutions and incubated for 1 hour at room temperature. The plates were washed twice with staining buffer. The secondary antibody against hamster Fc conjugated to AF647 (Jackson, 127-605-160) was added at 1:100 dilution (1.4 mg/ml stock) and incubated with the cells for 30 minutes at 4° C. followed by washing with staining buffer. Cells were subsequently were fixed for 10 minutes with 4% paraformaldehyde at room temperature. The plates were read on CytoFLEX LS (Beckman Coulter). Data was calculated as the percent-AF747 positive population (FIG. 9).

Figure 10:
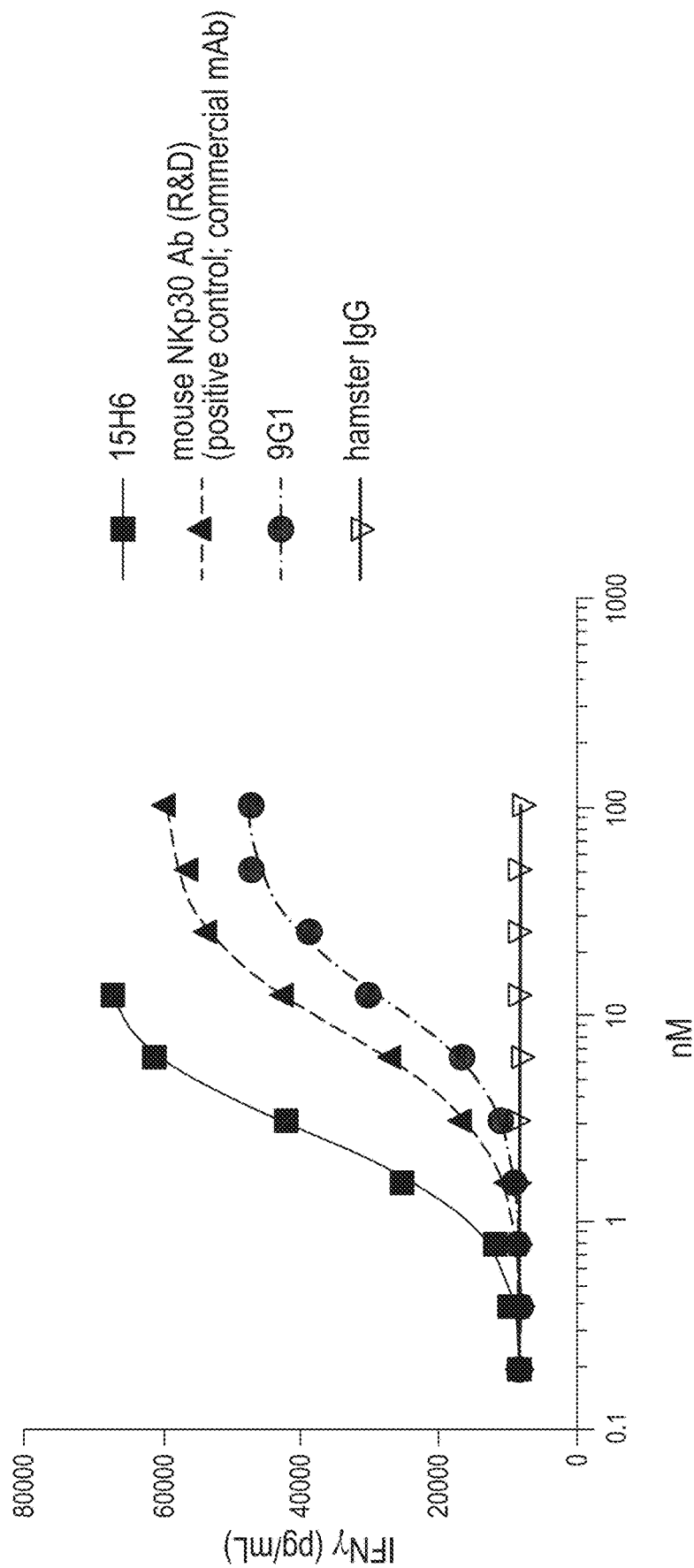
FIG. 10 is a graph showing activation of NK92 cells by NKp30 antibodies. Data were generated using hamster anti-NKp30 mAbs.

Example 4: Bioassay to Measure Activity of NKp30 Antibodies Using NK92 Cell Line NKp30 antibodies were three-fold serially diluted in PBS and incubated at 2-8° C. overnight in flat bottom 96 well plates. Plates were washed twice in PBS and 40,000 NK-92 cells were added in growth medium containing IL-2. Plates were incubated at 37° C., 5% CO2, humidified incubator for 16-24 hours before supernatants were collected. IFNγ levels in supernatants was measured following MSD assay instructions (FIG. 10). Supernatant collected from cells incubated with hamster isotype IgG was used as negative control and supernatants from cells incubated with NKp30 monoclonal antibody (R&D, clone 210847) was utilized as a positive control. Data were generated using hamster anti-NKp30 mABs.

Example 5: ELISA to Measure Binding of Humanized JOVI.1 Variant to Human TRBC1

Figure 7:
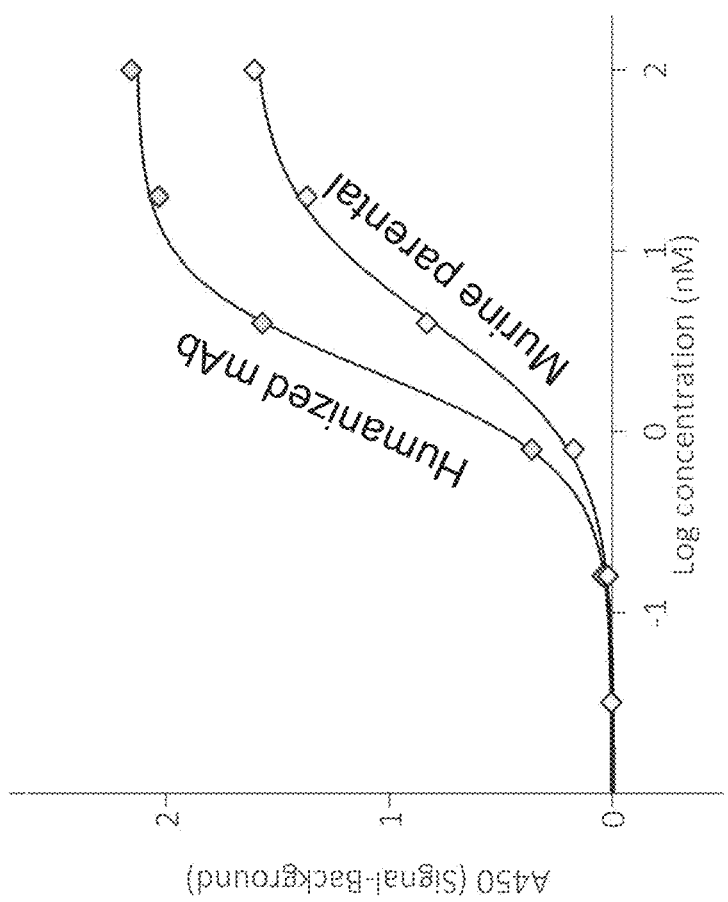
FIG. 7 is a graph showing binding of JOVI.1 and humanized JOVI.1 to human TRBC1.

An ELISA assay was performed to assay binding of a humanized JOVI.1 variant to human TRBC1. Microplates were coated with 1 ug/mL of each JOVI.1 variant separately in 100 uL and blocked with 2% BSA. Serial dilutions of hTRBC1, BIM0444 (7 points, 5-fold dilutions, 100 nM to 6.4 pM) were transferred to the coated and blocked plates at 100 uL/well and incubated for 1 hr at room temperature. Plates were washed three times and incubated for 30 mins with anti-his tag Fc horseradish peroxidase conjugate followed by addition of TMB, a substrate of HRP. The plates were developed for 5 mins, stopped with 1M HCL and read at a wavelength of 450 nm. The ELISA data show direct binding of anti-TRBC1 mAbs (bivalent) to human TRBC1 (FIG. 7).

Example 6: Assay to Measure Binding of Humanized JOVI.1 Variant to Human TRBC1

Figure 8:
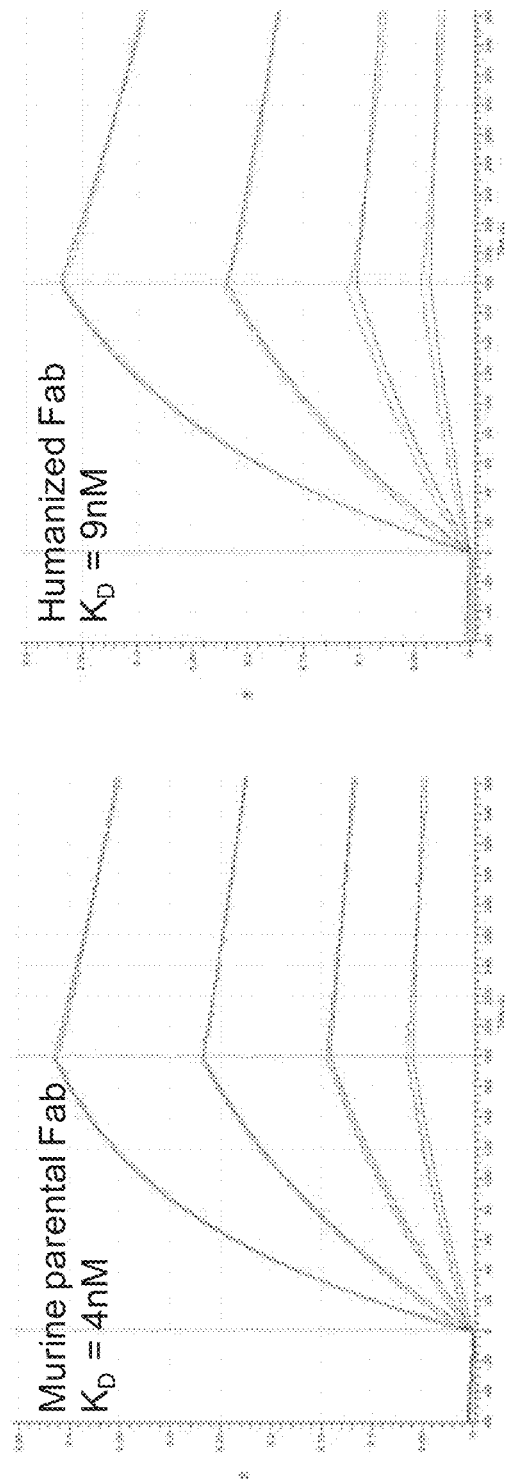
FIG. 8 is a set of graphs showing binding of JOVI.1 Fab (left) and humanized JOVI.1 Fab to human TRBC1 (right).

An Octet assay was performed to check binding of JOVI.1 humanized variants. Protein A biosensors were equilibrated in PBS at 25° C. The sensors were loaded with hTRBC1, BIM0444 at 20 ug/mL in PBS to a response of 1.5 nM followed by serial dilutions of JOVI1.1 fabs, BIM0446 and BIM0460 (7 points, 2-fold dilutions, 50 nM to 0.78 nM). Further Octet parameters include:
  Baseline: 30 sec in PBS
  Load: 20 sec to a response of 1.5 nm
  Baseline: 60 sec
  Association: 60 sec
  Dissociation: 60 sec in PBS Octet data showed binding of anti-TRBC1 Fabs to hTRBC1 (FIG. 8). hTRBC1 was captured on the sensor tip and dipped in solution containing different concentrations of monovalent Fabs.

Example 7: Generation and Characterization of Humanized Anti-NKp30 Antibodies A series of hamster anti-NKp30 antibodies were selected. These antibodies were shown to bind to human NKp30 and cynomolgus NKp30 and induce IFNγ production from NK-90 cells (data not shown). The VH and VL sequences of exemplary hamster anti-NKp30 antibodies 15E1, 9G1, 15H6, 9D9, 3A12, and 12D10 are disclosed in Table 9. The VH and VL sequences of exemplary humanized anti-NKp30 antibodies based on 15E1, 9G1, and 15H6 are also disclosed in Table 9. The Kabat CDRs of these antibodies are disclosed in Table 18 and Table 8.

Two humanized constructs based on 15E1 were selected. The first construct BJM0407 is a Fab comprising a heavy chain variable region comprising the amino acid sequence of SEQ ID NO: 7302 and a lambda light chain variable region comprising the amino acid sequence of SEQ ID NO: 7305. Its corresponding scFv construct BJM0859 comprises the amino acid sequence of SEQ ID NO: 7310. The second construct BJM0411 is a Fab comprising a heavy chain variable region comprising the amino acid sequence of SEQ ID NO: 7302 and a kappa light chain variable region comprising the amino acid sequence of SEQ ID NO: 7309. Its corresponding scFv construct BJM0860 comprises the amino acid sequence of SEQ ID NO 7311. BJM0407 and BJM0411 showed comparable biophysical characteristics, e.g., binding affinity to NKp30 and thermal stability. The scFv constructs BJM0859 and BJM0860 also showed comparable biophysical properties.

Example 8: Generation and Characterization of Humanized Anti-TRBC1 Antibodies murine anti-TRBC1 antibody JOVI.1 was humanized, leading to a number of humanized variants. The VH and VL sequences of exemplary humanized variants are disclosed in Table 4. One humanized variant BIM0460 was selected, which comprises a VH comprising the amino acid sequence of SEQ ID NO: 253 and a VL comprising the amino acid sequence of SEQ ID NO: 258. BIM0460 was further modified by germlining, leading to a number of germlined variants. The VH and VL sequences of exemplary germlined variants are also disclosed in Table 4. One germlined variant BJM0578 was selected, which comprises a VH comprising the amino acid sequence of SEQ ID NO: 7351 and a VL comprising the amino acid sequence of SEQ ID NO: 258. The Kabat CDRs of these humanized and germlined variants are disclosed in Table 6 and Table 3. BIM0460 was shown to bind to human TRBC1 with an affinity of 17 nM. BJM0578 was shown to bind to human TRBC1 with an affinity of 110 nM.

Example 9: Cytokine Secretion and T Cell Activation Profiling

This example explores whether ADCC-disabled formats would be preferable for antibodies that bind to TRBC1 and NKp30. JOVI.1 engagement upon plate coating or in solution upon Fc engagement induced T cell proliferation and activation (data not shown). This could be a liability for treating patients with T cell lymphoma, e.g., patients with peripheral T-cell lymphoma (PTCL).

Five constructs were generated as shown in FIGS. 11A-11E. BJM1052 is a bispecific antibody comprising an anti-TRBC1 Fab (based on BIM0460) and an anti-NKp30 scFv (based on BJM0407) (FIG. 11A). BJM1052 comprises the amino acid sequences of SEQ ID NO: 7379 (anti-TRBC1 HC), SEQ ID NO: 7380 (anti-TRBC1 LC), and SEQ ID NO: 7383 (anti-NKp30 scFv-Fc). BJM1052 comprises an N297A mutation in its Fc region. BJM1042 is a bispecific antibody comprising an anti-TRBC1 Fab (based on BJM0578) and an anti-NKp30 scFv (based on BJM0407) (FIG. 11B). BJM1042 comprises the amino acid sequences of SEQ ID NO: 7382 (anti-TRBC1 HC), SEQ ID NO: 7380 (anti-TRBC1 LC), and SEQ ID NO: 7383 (anti-NKp30 scFv-Fc). BJM1042 comprises an N297A mutation in its Fc region. BJM0889 is a single arm antibody comprising an anti-TRBC1 Fab (based on BIM0460) (FIG. 11C). BJM1083 is a single arm antibody comprising an anti-TRBC1 Fab (based on BJM0578) (FIG. 11D). Both BJM0889 and BJM1083 comprise an N297A mutation in the Fc region. BJM1053 is similar to BJM11052, except that BJM1053 has an ADCC enabled Fc region.

Figure 12A:
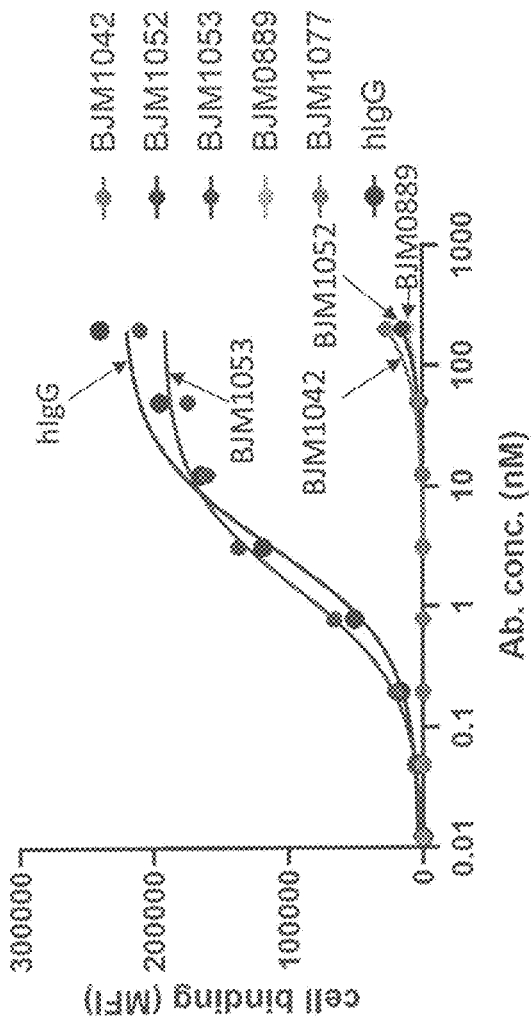
FIGS. 12A-12B are graphs showing binding of antibodies to Fcγ receptor-expressing THP1 cells.
Figure 12B:
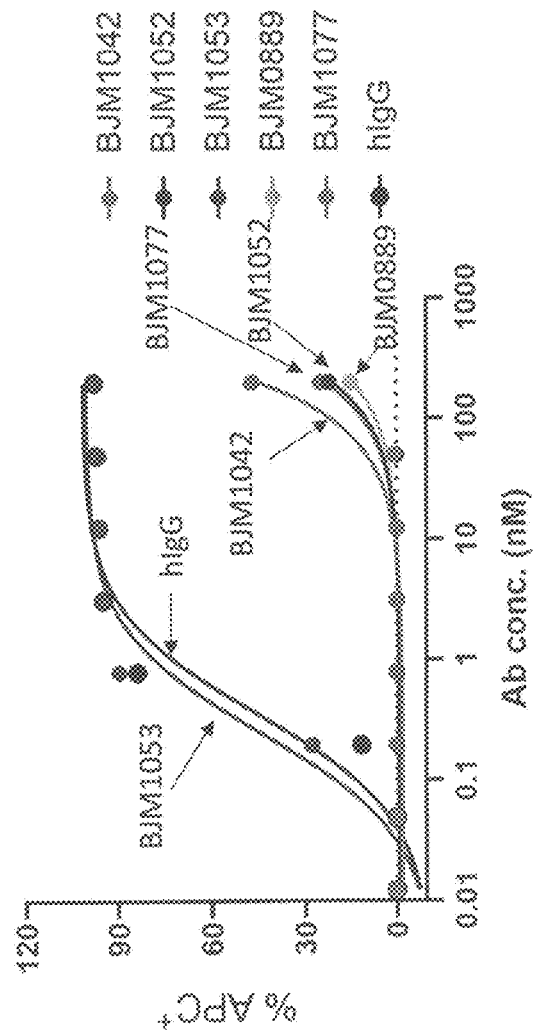

As shown in FIGS. 12A and 12B, Fc enabled antibodies BJM1053 and hIgG1 bound to THIP1 cells which express Fcγ receptors, whereas N297A mutated antibodies (BJM1052, BJM1042, and BJM0889) did not show significant binding.

Figure 13A:
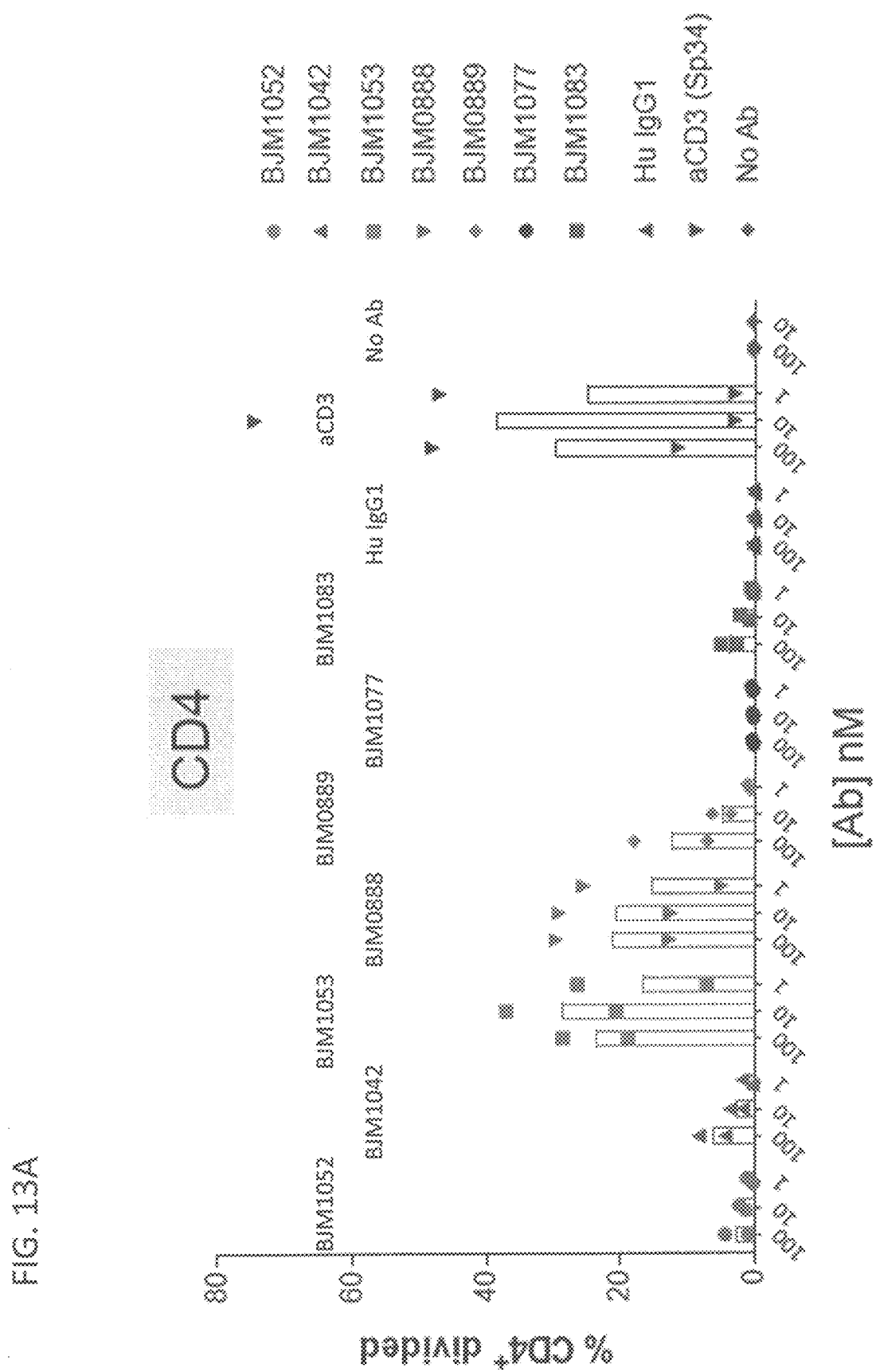
Figure 13B:
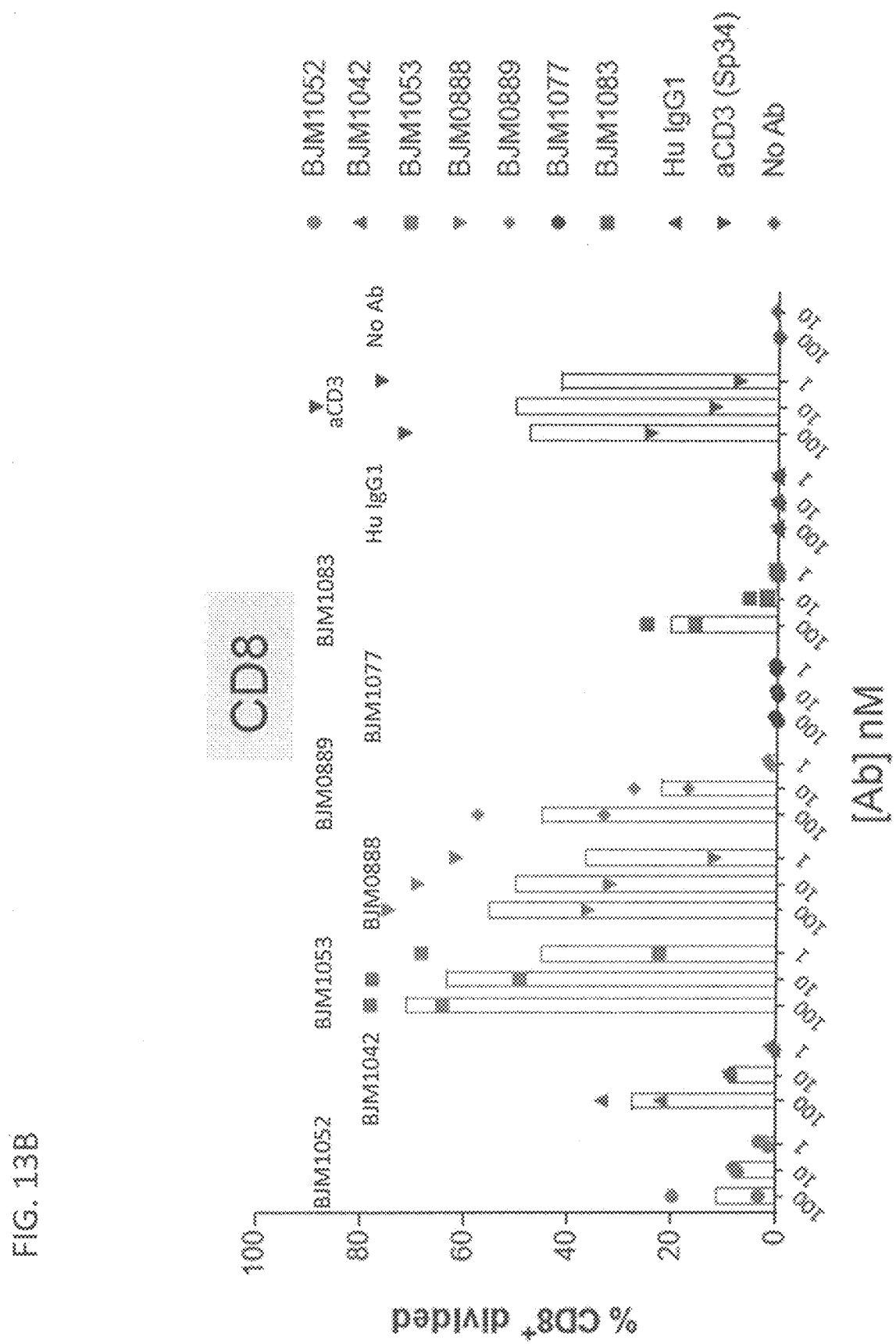
Figure 13D:
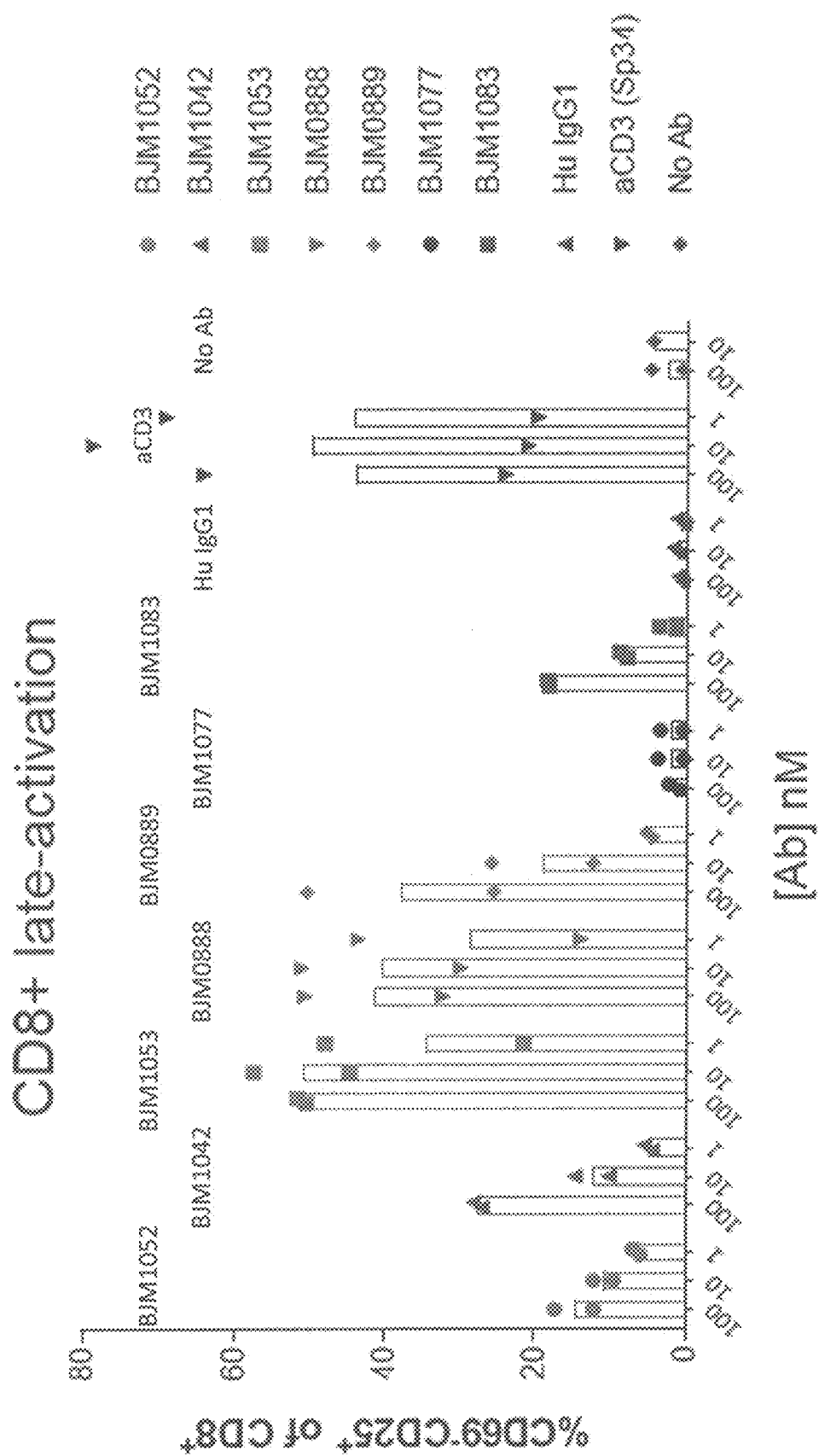

To test if antibodies with N297A mutation (Fc disabled) are safer, anti-TRBC1/NKp30 antibodies and control molecules were added to PBMCs in solution at 100, 10 or 1 nM and T cell proliferation was measured on Days 1 and Day 5 Fc disabled antibodies BJM1052 and BJM1042 showed less lymphocyte clustering than the Fc enabled antibody BJM1053 (data not shown). T cell activation was significantly reduced in PBMCs treated with BJM1052 and BJM1042 on Day 5, as demonstrated by the percentage of proliferating T cells (FIGS. 13A and 13B) as well as the percentage of CD69−CD25+ T cells (FIGS. 13C and 13D).

Example 10: In Vitro Binding to TRBC1 and NKp30

Figure 14A:
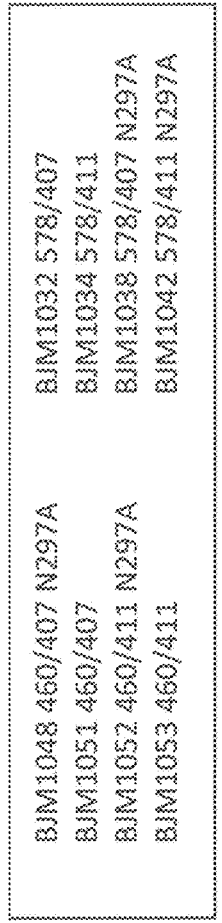
FIGS. 14A-14D are schematic representations of anti-TRBC1/NKp30 antibodies.
Figure 14B:
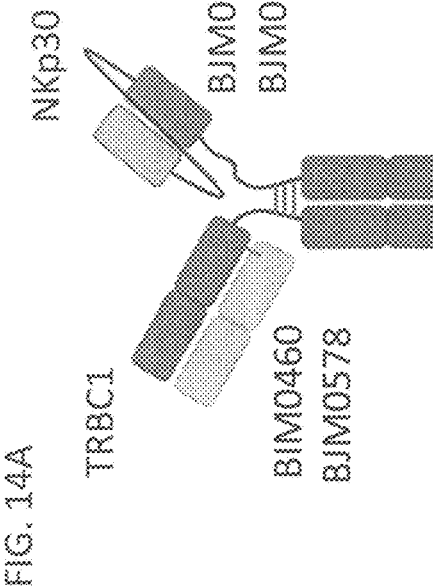

Various constructs were generated as shown in FIGS. 14A-14D. Shown in FIG. 14A is a bispecific antibody comprising an anti-TRBC1 Fab (based on BIM0460 or BJM0578) and an anti-NKp30 scFv (based on BJM0407 or BJM0411). The bispecific antibodies may or may not have an N297A mutation in their Fc regions. The molecules listed in FIG. 14B have the configuration shown in FIG. 14A.

Figure 14C:
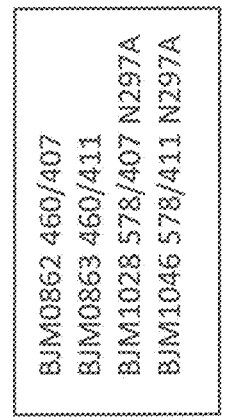
Figure 14D:
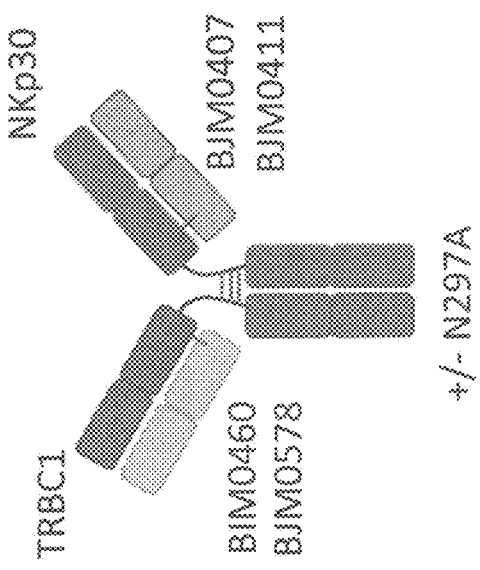

FIG. 14C shows a bispecific antibody comprising an anti-TRBC1 Fab (based on BIM0460 or BJM0578) and an anti-NKp30 Fab (based on BJM0407 or BJM0411). The bispecific antibodies may or may not have an N297A mutation in their Fc regions. The molecules listed in FIG. 14D have the configuration shown in FIG. 14C.

Figure 15A:
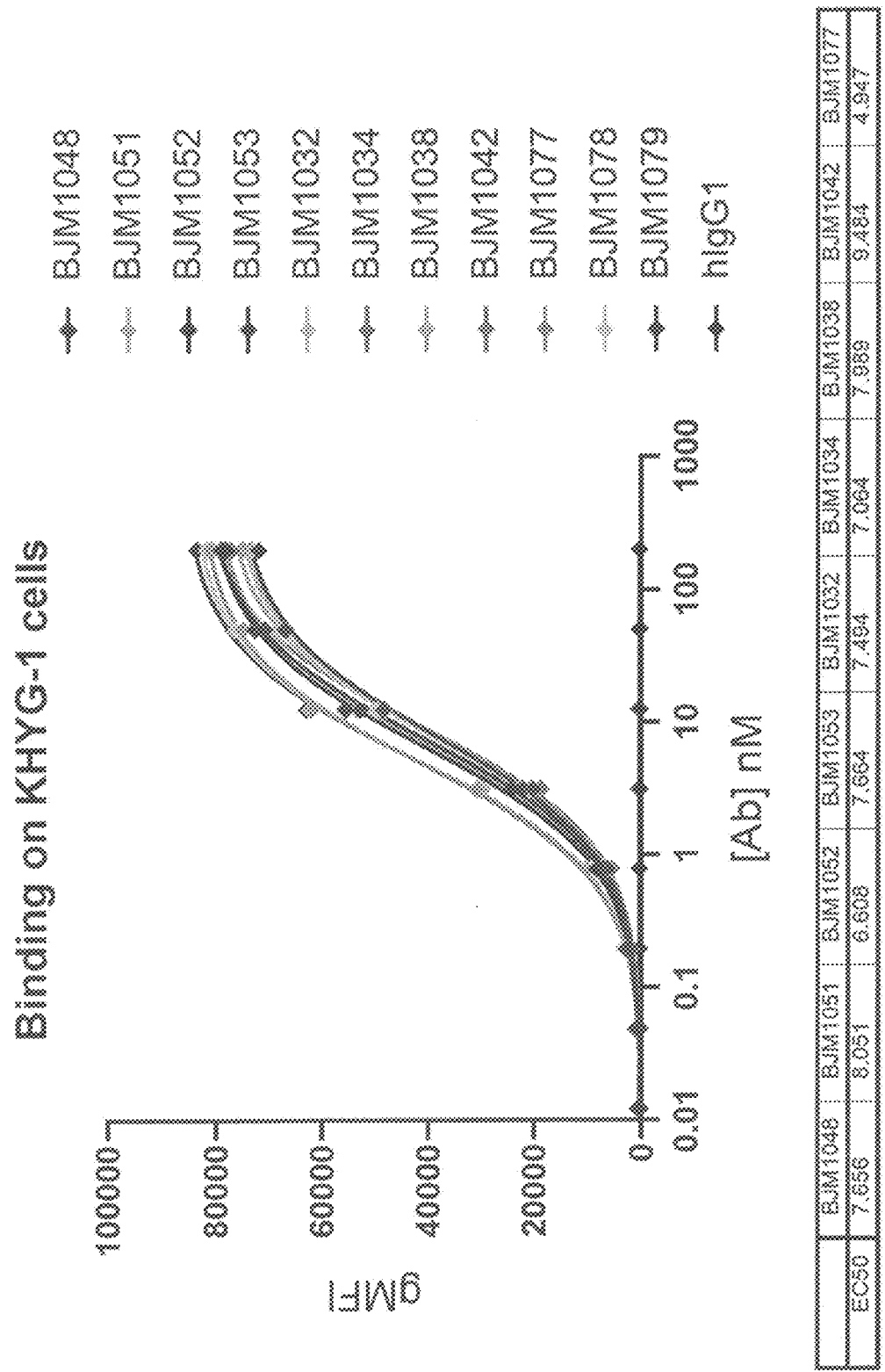
Figure 15B:
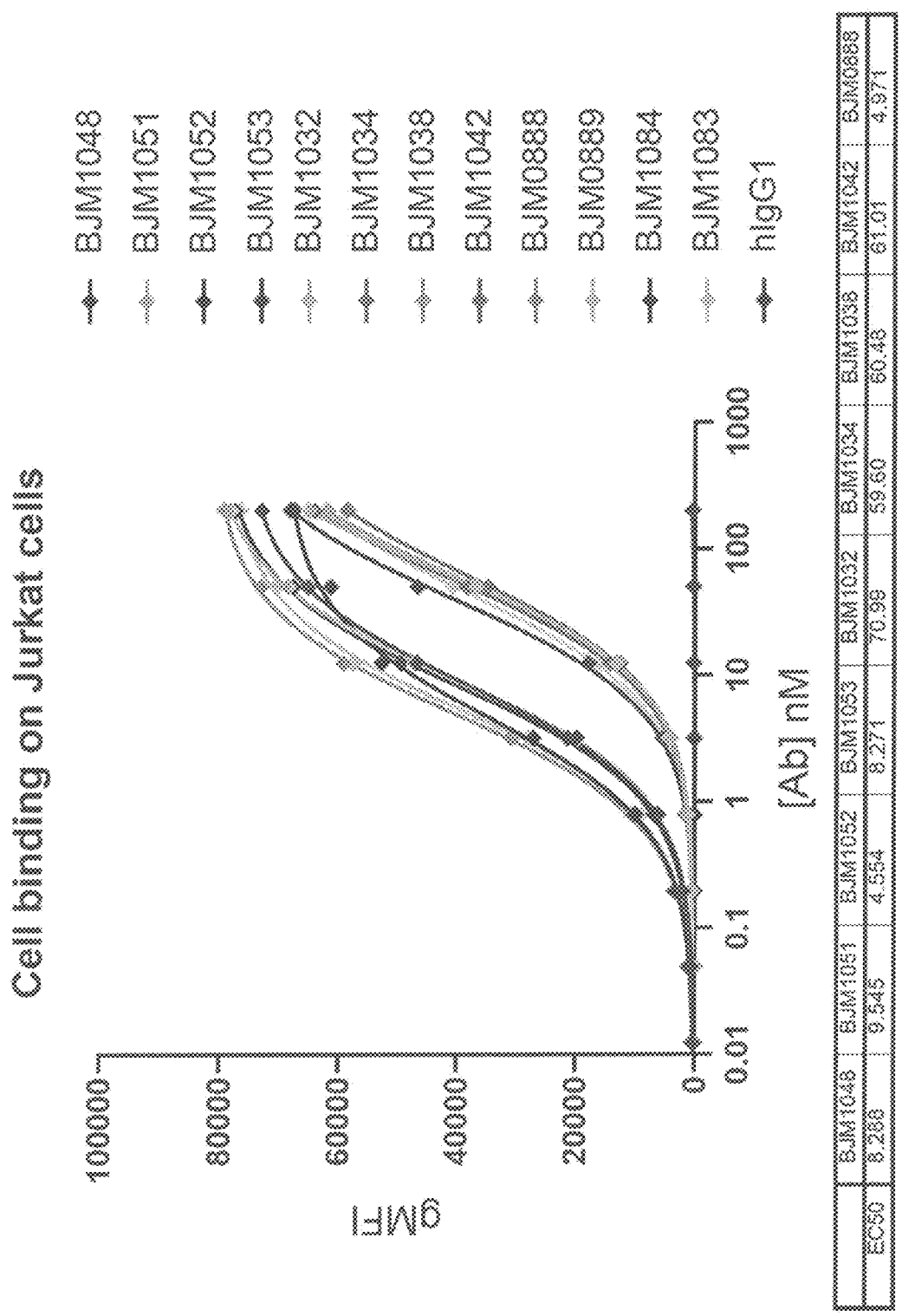

All the anti-TRBC1/NKp30 antibodies tested exhibited binding to NK cell line KHYG-1 (FIGS. 15A and 15D) as well as TRBC1 Jurkat cells (FIGS. 15B and 15D).

Example 11: In Vitro Cytolysis of TRBC1+ Cell Lines

In this example, anti-TRBC1/NKp30 antibodies were tested for their ability to induce killing of TRBC1-expressing cells in the presence of NK cells. The antibodies tested in this Example are shown in FIGS. 11A-11E.

Figure 16C:
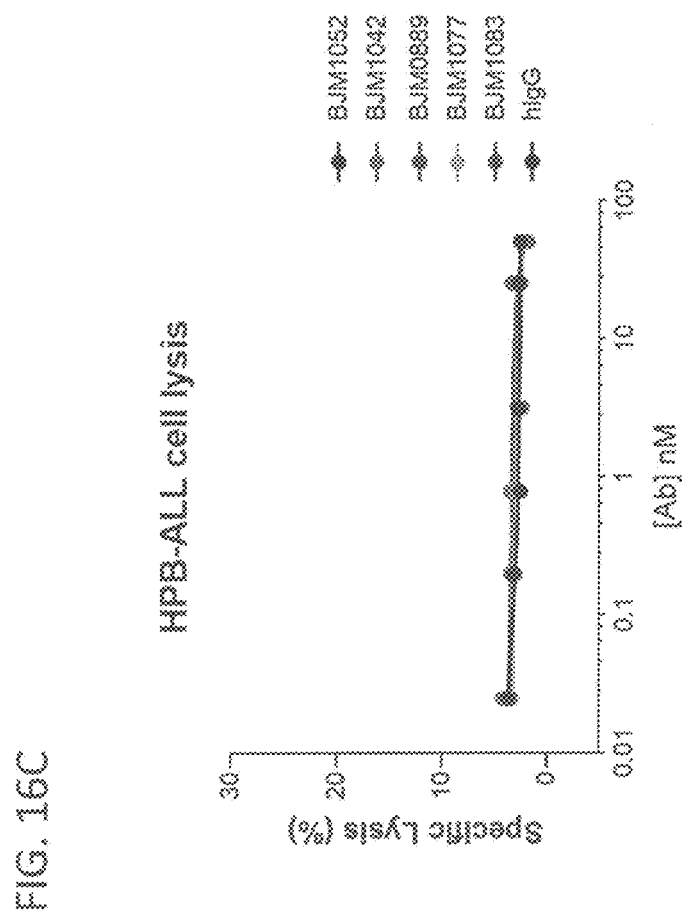

In a first study, NK-92 effector cells were cultured in 5:1 ratio with CFSE labeled target cells for 4 h. Target cell lysis was measured using flow cytometry and gating on dead target cells. Anti-TRBC1/NKp30 bispecific antibodies BJM1052 and BJM1042 induced killing of TRBC1+ Jurkat cells (FIG. 16A) and H9 cells (FIG. 16B), but not TRBC2+ HPB-ALL cells (FIG. 16C), in the presence of NK-92 effector cells.

Figure 17C:
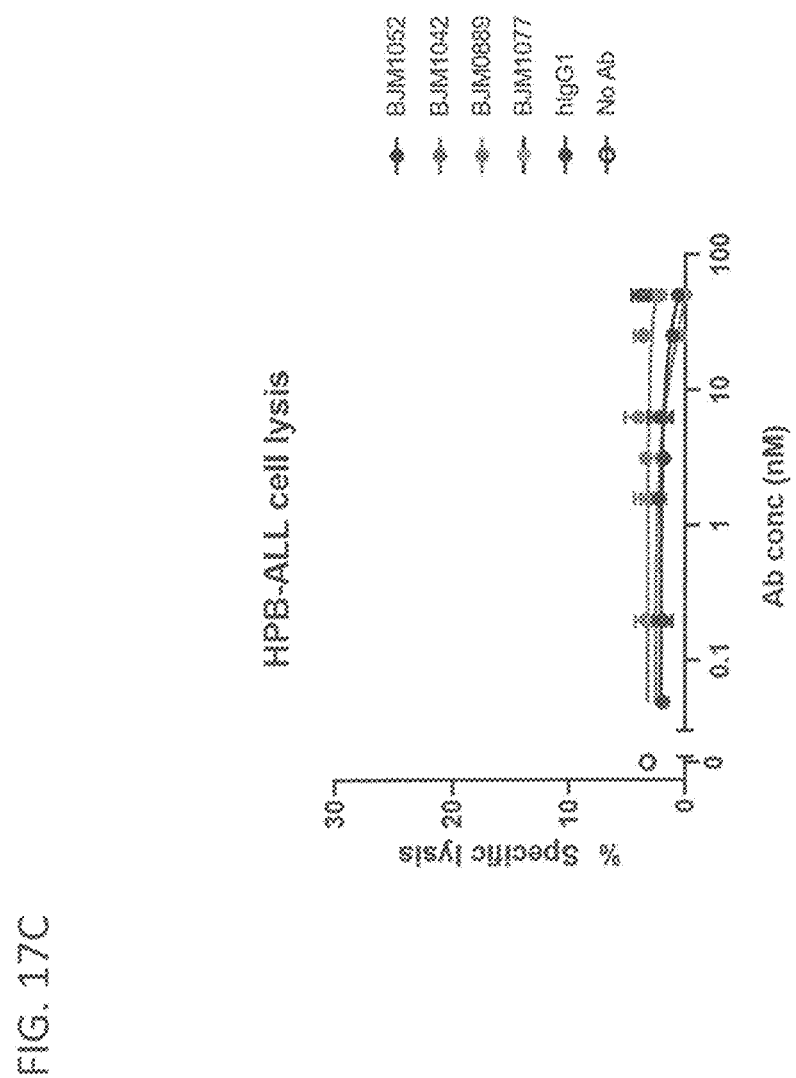

In a second study, primary NK cells were cultured in 5:1 ratio with CFSE labeled target cells for 4 h. For H9 cells, 10:1 E:T ratio was used Target cell lysis was measured using flow cytometry. Anti-TRBC1/NKp30 bispecific antibodies BJM1052 and BJM1042 induced killing of TRBC+ Jurkat cells (FIG. 17A) and H9 cells (FIG. 17B), but not TRBC2+ HPB-ALL cells (FIG. 17C), in the presence of primary NK cells.

Figure 18A:
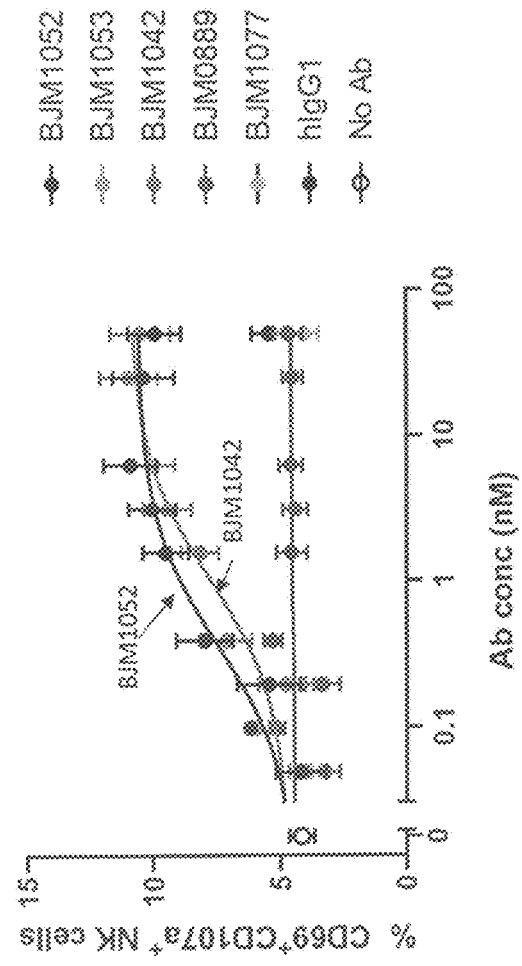
FIGS. 18A-18C are graphs showing activation of NK cells after co-culture with TRBC1+ Jurkat cells in the presence of anti-TRBC1/NKp30 antibodies.
Figure 18B:
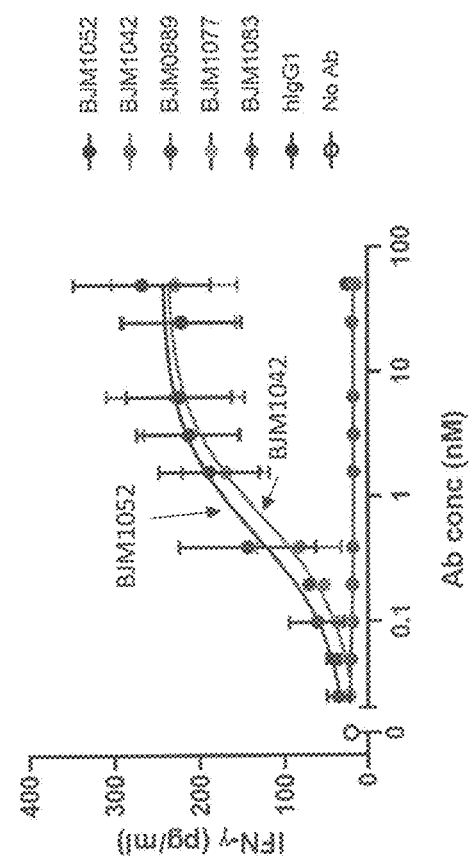
Figure 18C:
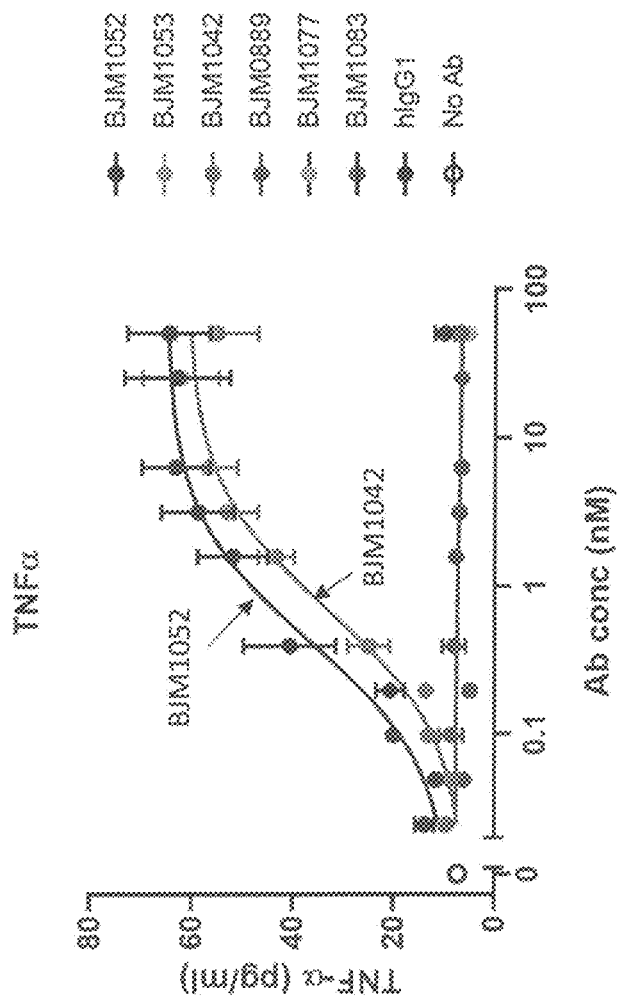

In a third study, NK cells and target cells were co-cultured for 4 hours in the presence of anti-TRBC1/NKp30 antibodies BJM1052 and BJM1042, supernatants were collected, and cytokine levels were measured using MSD Target cell lysis correlated with NK cell activation, as demonstrated by the percentage of CD69+CD107a+ NK cells (FIG. 18A), IFNγ secretion (FIG. 18B), and TNFα secretion (FIG. 18C).

Figure 19A:
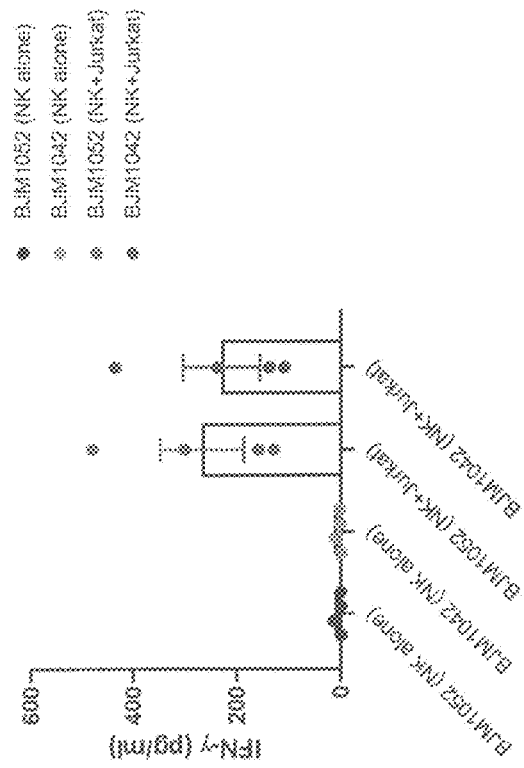
FIGS. 19A-19B are graphs showing cytokine levels produced by NK cells in the presence or absence of TRBC1+ Jurkat cells.
Figure 19B:
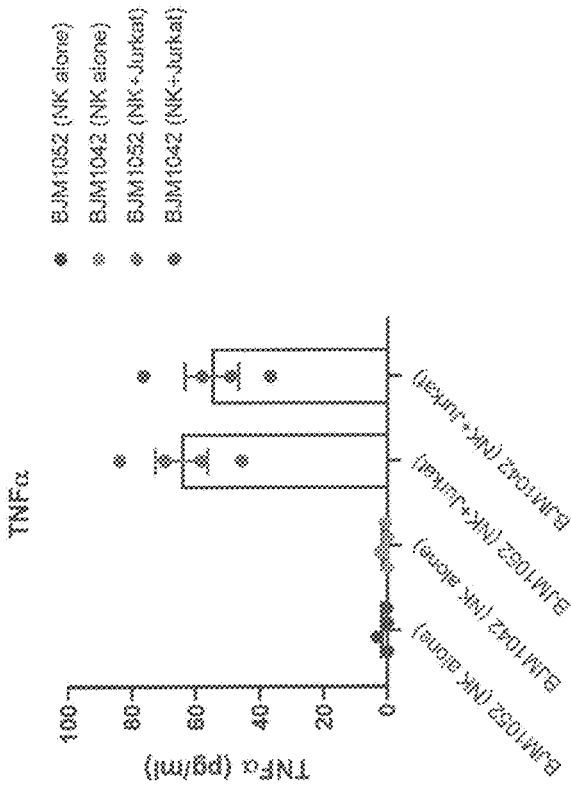
Figure 20:
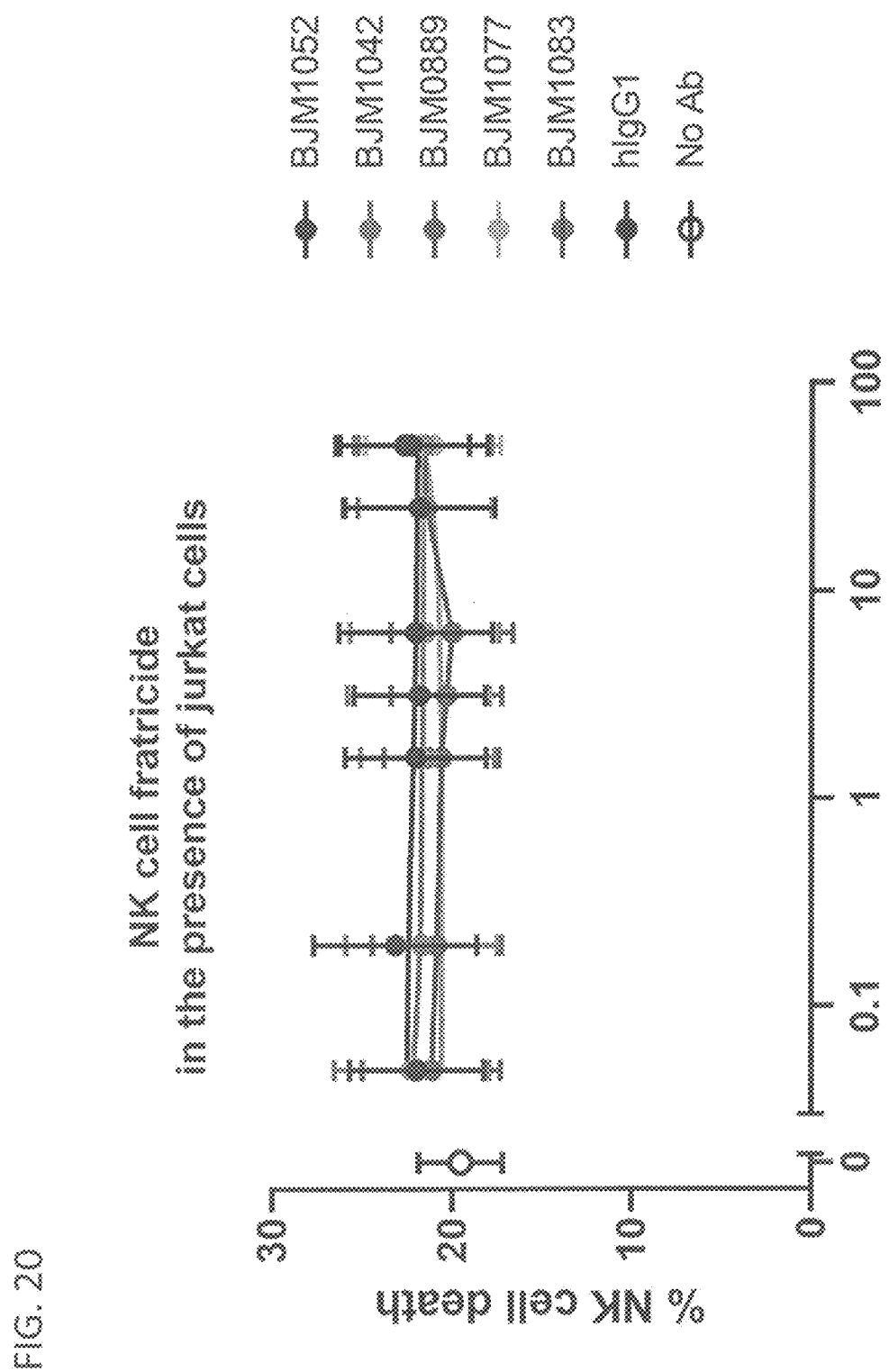
FIG. 20 is a graph showing % NK cell death induced by the indicated antibodies in the presence of TRBC1+ Jurkat cells.

The next study examines whether anti-TRBC1/NKp30 antibodies BJM1052 and BJM1042 activates NK cells in the absence of target cells. Primary NK cells were incubated with 50 nM of antibodies for 4 h in the absence of target cells, and then supernatants were collected to measure IFNγ and TNFα levels. As shown in FIGS. 19A and 19B. NK cell activation mediated by anti-TRBC1/NKp30 antibodies required the presence of both NK cells and target cells. Finally, anti-TRBC1/NKp30 antibodies BJM1052 and BJM1042 did not induce NK cell death in the presence of target cells (FIG. 20).

Example 12: Selective In Vitro Cytolysis of Patient-Derived TRBC1+ PDX

Common subtypes of T-cell lymphoma include: Peripheral T-Cell Lymphoma, Not Otherwise Specified (PTCL-NOS); Anaplastic Large Cell Lymphoma (ALCL); Angio-immunoblastic T-Cell Lymphoma (AITL); and Cutaneous T-Cell Lymphoma (CTCL). Uncommon subtypes of T-cell lymphoma include: Adult T-Cell Leukemia/Lymphoma (ATLL); T-Cell Lymphoblastic Lymphoma; Hepatosplenic Gamma-Delta T-Cell Lymphoma, Enteropathy-Type T-Cell Lymphoma; Nasal NK/T-Cell Lymphomas; Treatment-Related T-Cell Lymphomas. Similar frequency and expression of TRBC1 was observed in PBMCs isolated from healthy donors and PBMCs isolated from PTCL patients (data not shown).

Two Patient-Derived Xenograft (PDX) samples were tested to be TRBC1 positive: PDX3 was derived from a patient with Acute Lymphoblastic Leukemia (T-ALL), and PDX6 was derived from a patient with Primary cutaneous CD30+ T-Cell Lymphoproliferative Disorder (CTCL).

Figure 21B:
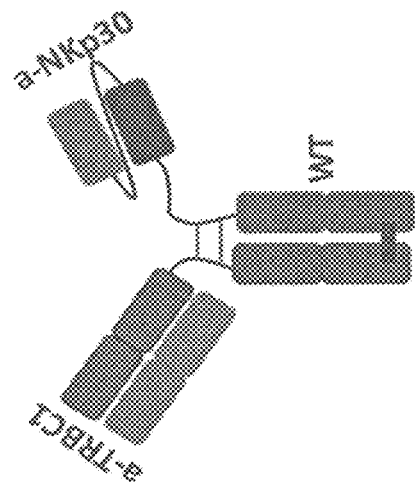
FIGS. 21A and 21B are schematic representations of a single arm anti-TRBC1 antibody and a bispecific anti-TRBC1/NKp30 antibody, respectively.
Figure 21A:
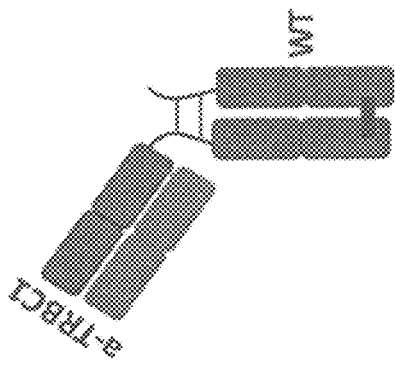

The antibodies shown in FIGS. 21A and 21B were used in a functional killing assay. BJM0145 is a single arm anti-TRBC1 antibody BJM0773 is a bispecific antibody comprising an anti-TRBC1 Fab and an anti-NKp30 scFv. PDX samples were labeled with CFSE, cultured with primary NK cells or KHYG1 cells at 5:1 ratio of E:T for 5 hours in the presence of BJM0145 or BJM0773 (0.01-10 nM). Specific killing was measured using the following calculation:

$$\frac{\% \text{ dead treated (PDX+NK)} - \% \text{ dead PDX}}{100\% \text{ (Max killing)} - \% \text{ dead PDX}}$$

As shown in FIGS. 22A-22D, anti-TRBC1/NKp30 antibody BJM0773 efficiently killed TRBC1 positive PDX3 and PDX6. The single arm anti-TRBC1 antibody BJM0145 exhibited weak killing in the presence of primary NK cells due to ADCC (FIGS. 22A and 22C), but not in the presence of KHYG1 cells, which are CD16 deficient NK cells (FIGS. 22B and 22D). The single arm anti-TRBC1 antibody or the bispecific anti-TRBC1/NKp30 antibody did not kill TRBC1 negative PDX (data not shown).

Example 13: In Vitro Cytolysis of TRBC1+ Jurkat Cells Using NK Cells from PTCL Patients This example examines whether anti-TRBC1/NKp30 antibodies can mediate killing of TRBC1+ target cells in the presence of NK cells isolated from PTCL patients.

NK cells and NKp30+ NK cells are present in normal proportions in PTCL patient PBMCs (data not shown). NK cells were enriched from PTCL patients and healthy donor PBMCs by negative selection and then incubated overnight with 200 U/ml IL-2 On the following day. NK cells were co-cultured with Jurkat cells for 4 h in the presence of 10 nM antibodies.

Figure 23:
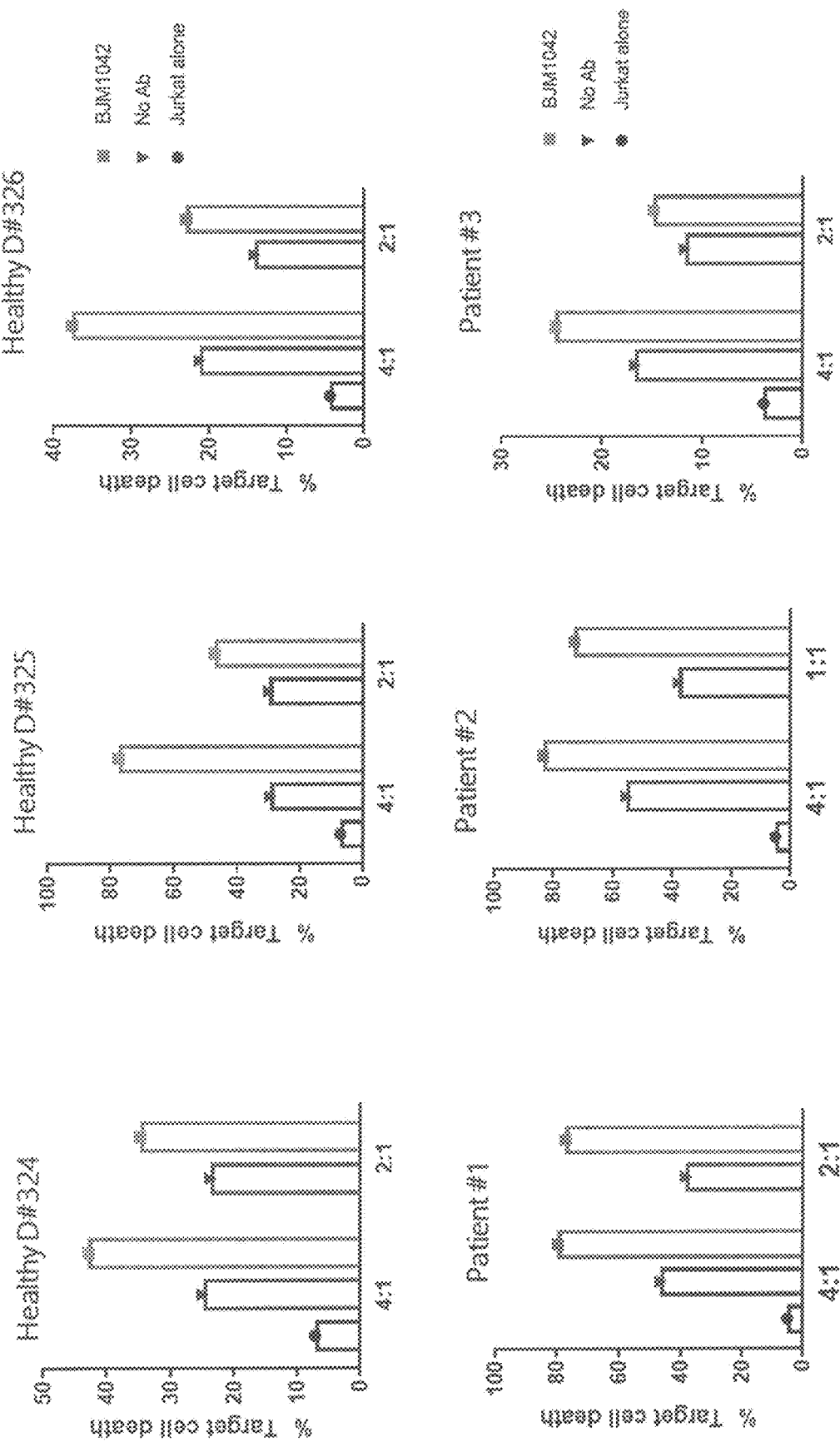
FIG. 23 is a panel of figures showing killing of TRBC1+ Jurkat cells in the presence of the indicated antibodies. The NK cells tested were isolated from healthy donors (upper panel) or from PTCL patients (lower panel).
Figure 24:
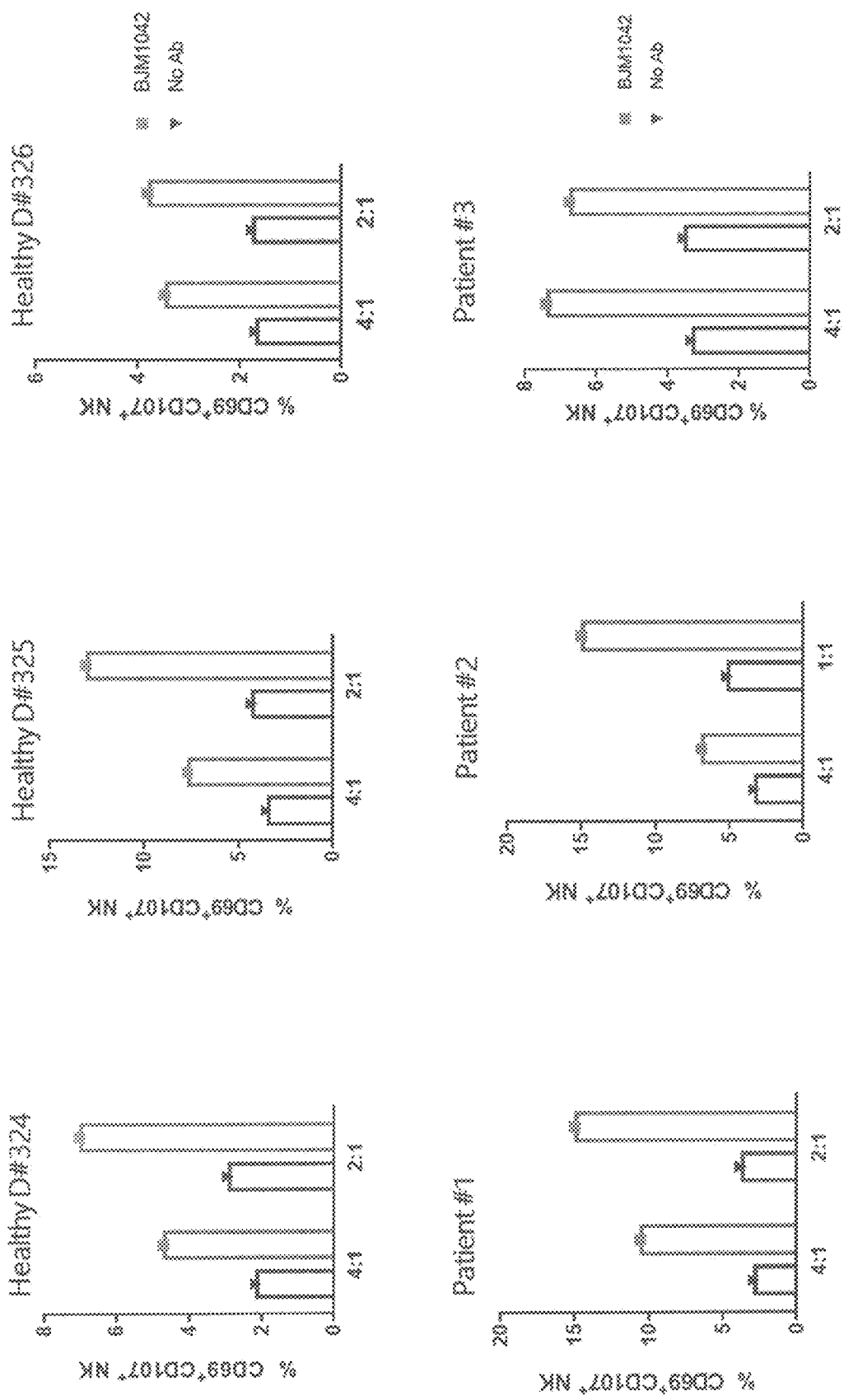
FIG. 24 is a panel of figures showing activation of NK cells during the killing assay shown in FIG. 23. The NK cells tested were isolated from healthy donors (upper panel) or from PTCL patients (lower panel).
Figure 25A:
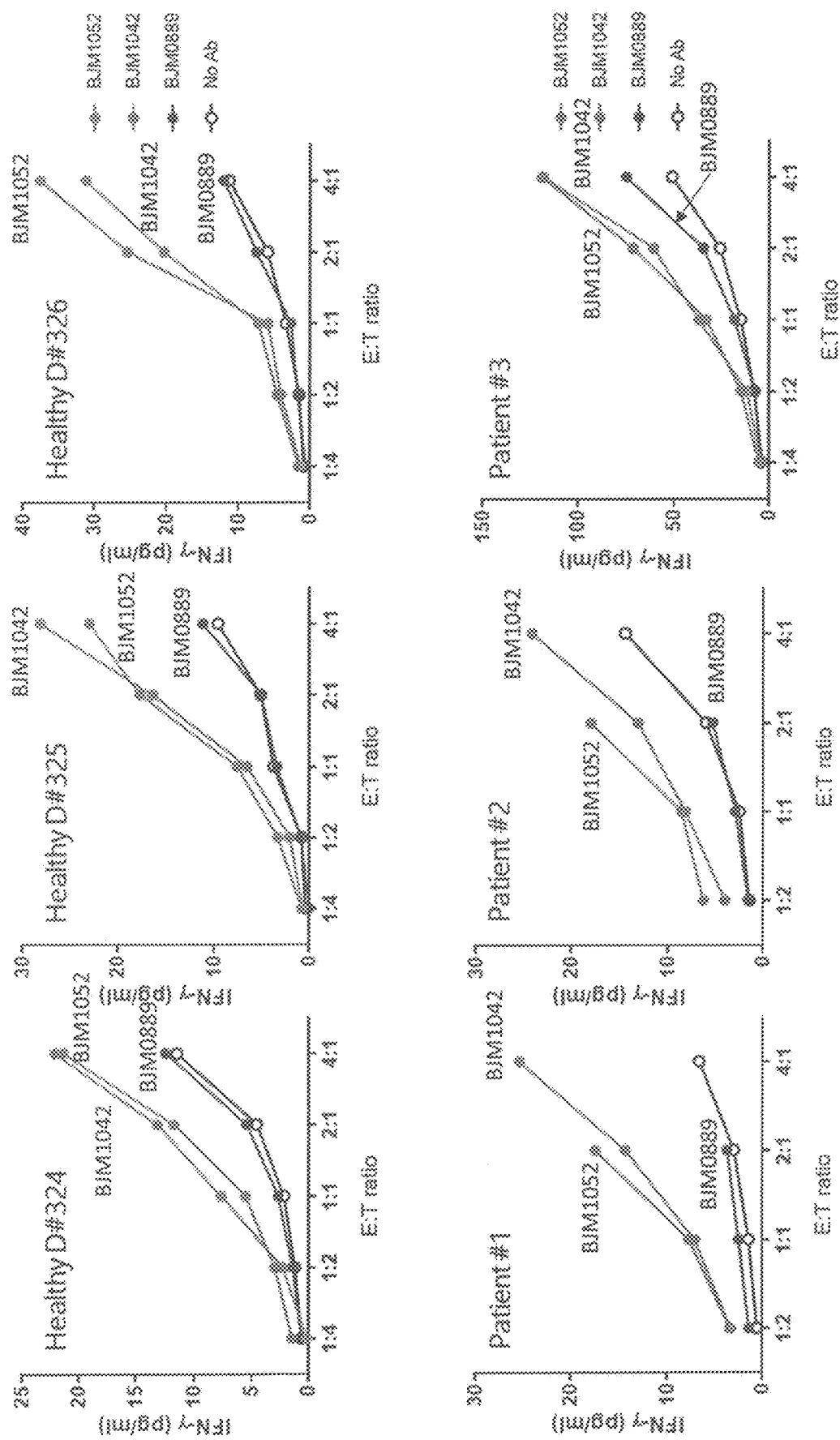
FIGS. 25A and 25B are a panel of figures showing IFNγ (FIG. 25A) or TNFα (FIG. 25B) secretion levels of NK cells when co-cultured with Jurkat cells in the presence of the indicated antibodies. The NK cells tested were isolated from healthy donors (upper panel) or from PTCL patients (lower panel).
Figure 25B:
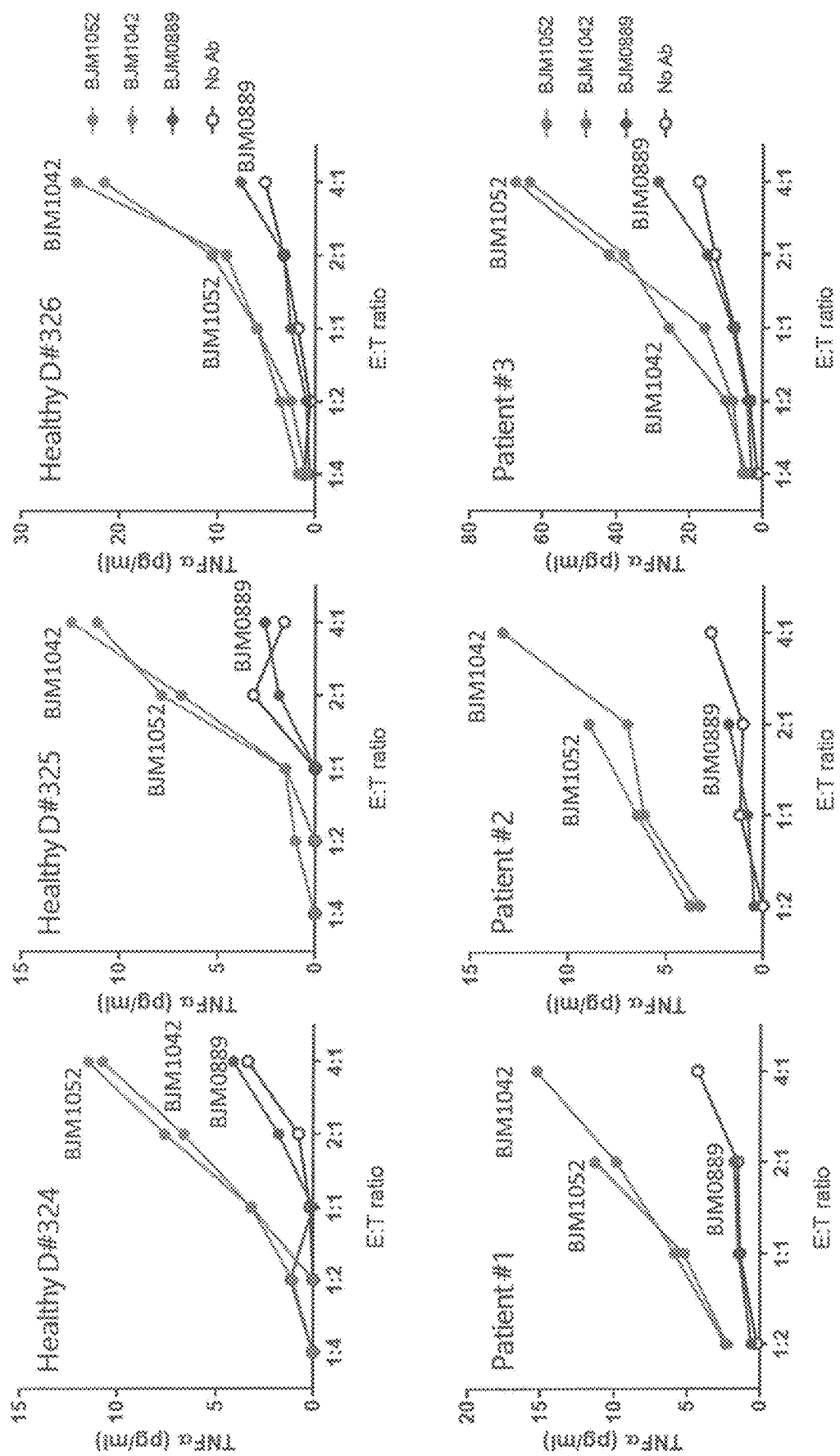

As shown in FIG. 23, PTCL patient derived NK cells killed TRBC1+ Jurkat cells in the presence of the anti-TRBC1/NKp30 antibody BJM1042. NK cells were activated during the killing assay, as demonstrated by the percentage of CD69+CD107+ NK cells (FIG. 24). The bispecific anti-TRBC1/NKp30 antibodies BJM1052 and BJM1042 induced higher levels of IFNγ (FIG. 25A) and TNFα (FIG. 25B) than the single arm anti-TRBC1 antibody FJM0889 did.

Example 14: Competition with B7-H6, a Natural Ligand for NKp30

The natural ligands of NKp30 includes B7-H6, pp65, BAT3, and BAG6. B7-N6 is found on many cancer cell lines and primary cancer cells (e.g., T- and B-cell lymphoma, leukemia, and melanoma). Membrane-bound B7-1-16 can mediate activation of primary human NK cells and killing of target cells. Soluble B7-H6, on the other hand, is found in serum or tumor microenvironment and can inhibit binding of anti-NKp30 mAbs, down-modulate NKp30 expression, and dampen NKp30-mediate activation and target cell killing.

This example examines whether the bispecific anti-TRBC1/NKp30 antibodies compete with B7-H6 for binding to NKp30.

Figure 26A:
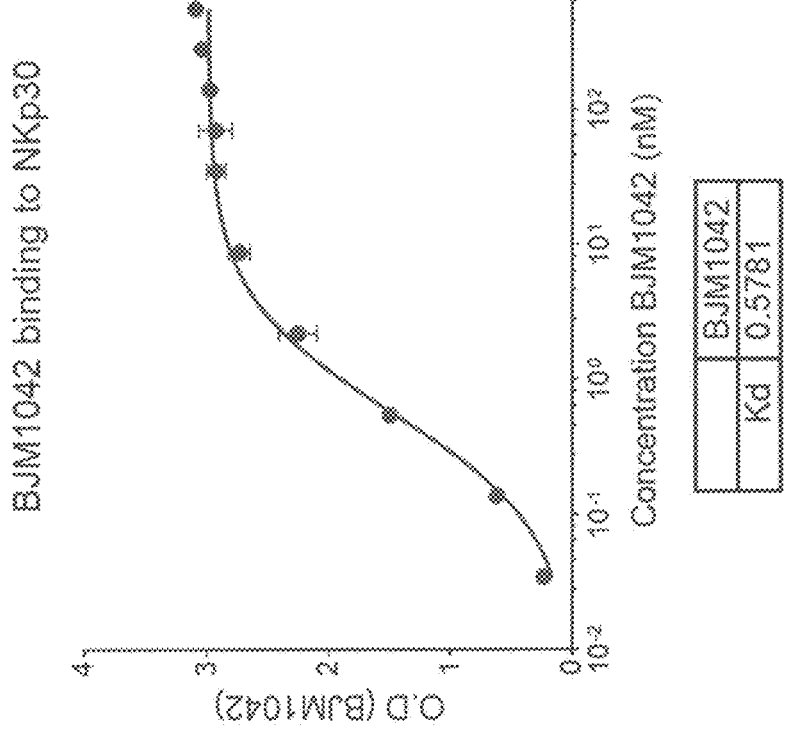
FIGS. 26A-26C are graphs measuring binding to NKp30 in ELISA.
Figure 26B:
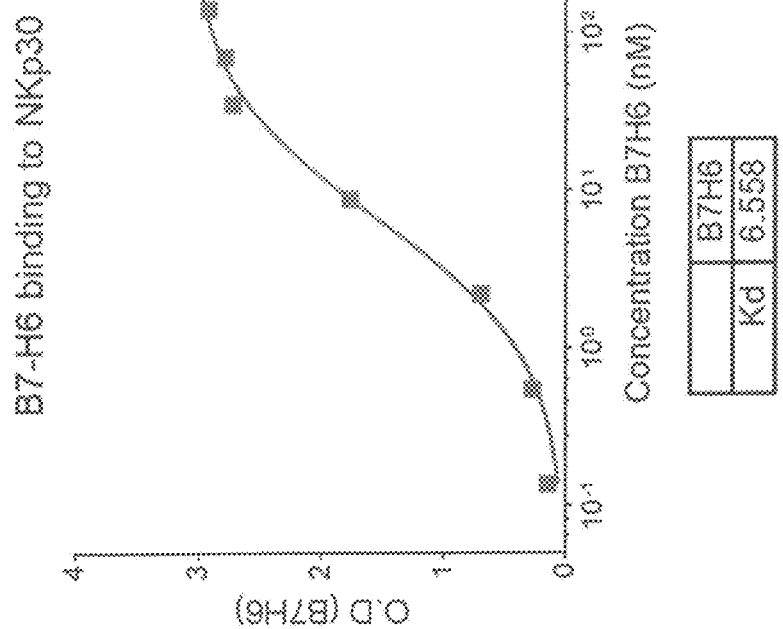

As shown in FIGS. 26A and 26B, the bispecific anti-TRBC1/NKp30 antibody BJM1042 bound more strongly to NKp30 than B7-H6. In a competition assay, B7H6 (4 µg/ml, ~143 nM) and varying concentration of antibodies (BJM1042, anti-NKp30 or anti-NKp46) were added simultaneously to NKp30 coated ELISA plate. As shown in FIG.

Figure 26C:
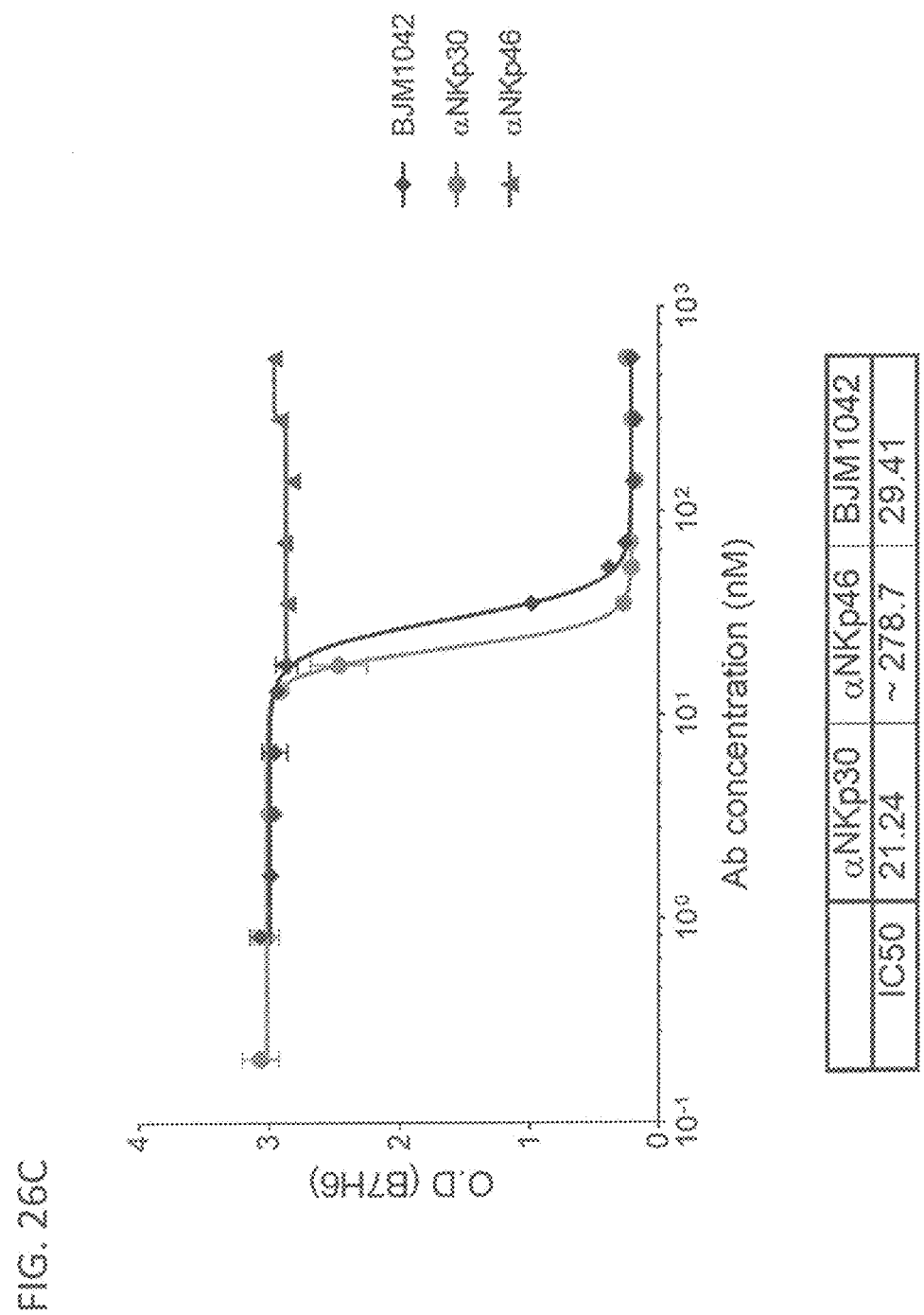

26C, B7H6 binding signal was diminished with increasing concentrations of competing antibodies BJM1042 competed with B7-H6 for binding with NKp30, to a similar level as a positive control anti-NKp30 antibody (FIG. 26C). A negative control anti-NKp46 antibody did not interfere with B7-H6 binding to NKp30, suggesting that the interference observed in this ELISA was specific (FIG. 26C).

Example 15: In-Vivo Killing of TRBC1 Cell Line Derived Model

This example examines the anti-tumor activity of the anti-TRBC1/NKp30 antibody BJM1042 in an in vivo model.

On day 0, NOG-IL-15 mice were implanted subcutaneously with 19 tumor cells. 16 days post tumor implant, mice were engrafted with in vitro expanded primary NK cells. Two weeks following NK implant (31 days post tumor implant), mice were randomized by tumor volume and dosed with 1 mg/kg BJM1042 or associated controls. Tumor volume and body weight was measured daily following exposure to test articles.

Figure 27A:
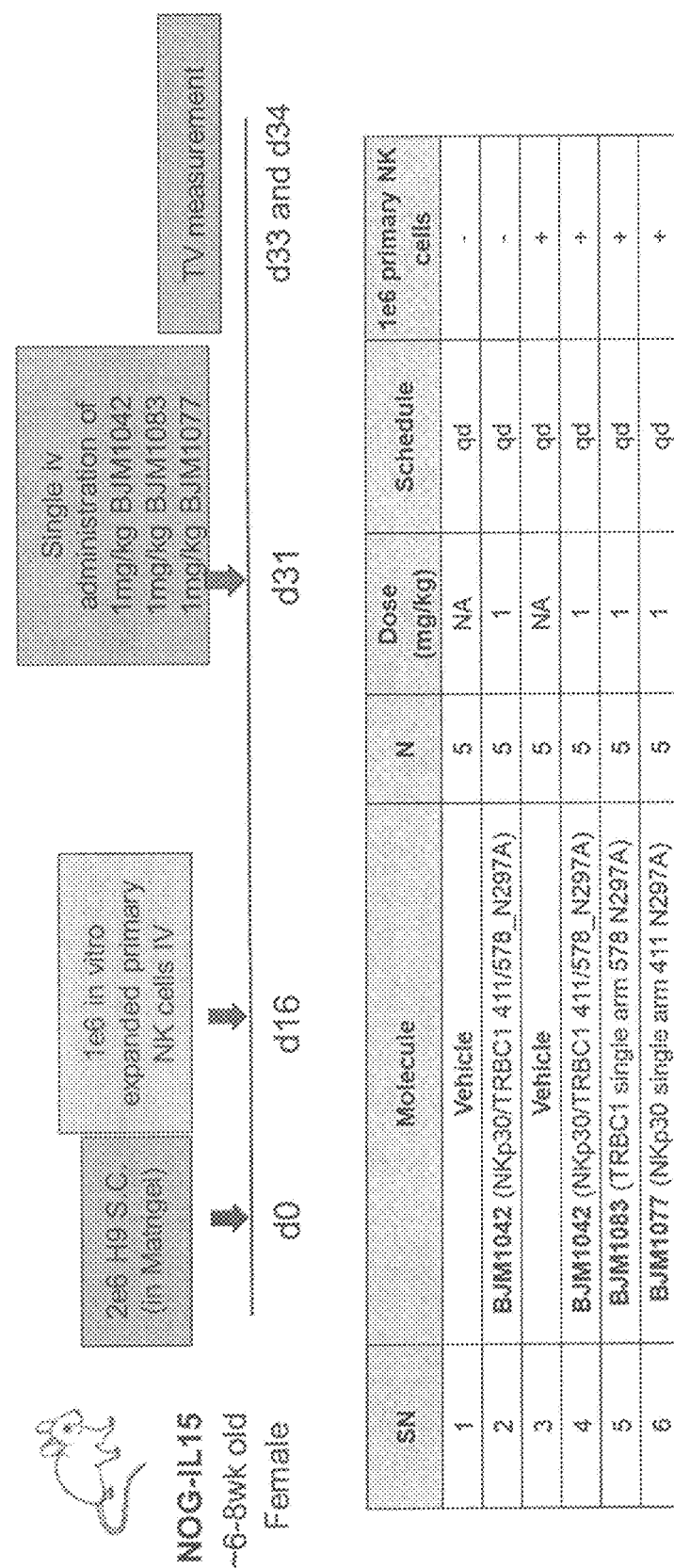
FIGS. 27A-27C are graphs from an in vivo TRBC1+ tumor study.
Figure 27B:
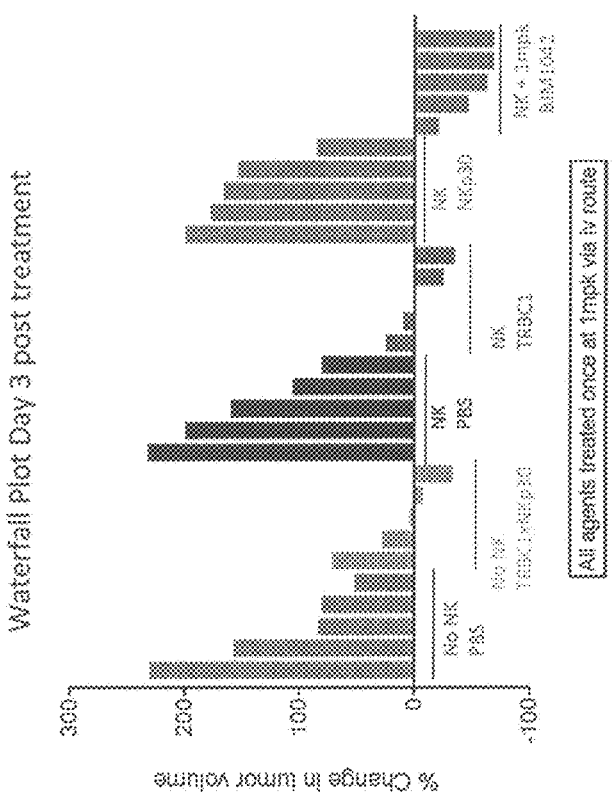
Figure 27C:
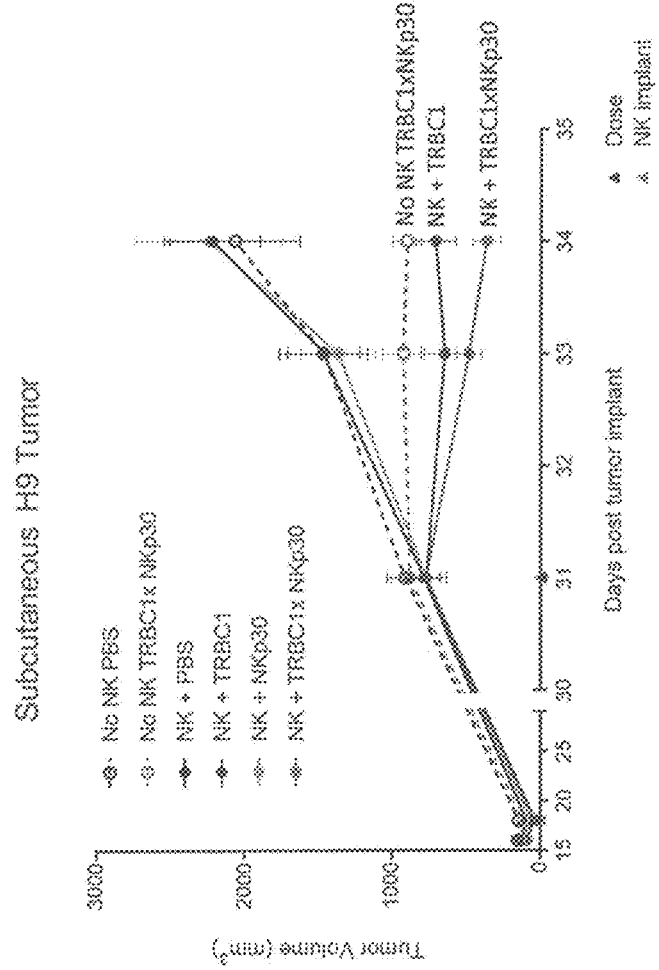

The anti-TRBC1/NKp30 antibody BJM1042 induced regression of subcutaneous H9 tumors in NOG IL-15 mice engrafted with primary NK cells (FIGS. 27B and 27C). BJM1042 also inhibited tumor growth in the absence of NK cells, but to a lesser extent compared to treatment in the presence of NK cells (FIGS. 27B and 27C). Similar results were observed with the anti-TRBC1 control antibody BJM1083 (FIGS. 27B and 27C).

Example 16: In-Vivo Specificity for TRBC1

In this example, the specificity of BJM1042 was evaluated using TRBC2-expressing HPB-ALL xenografts in primary NK cell engrafted NOG-IL-15 mice.

On day 0, NOG-IL-15 mice were implanted subcutaneously with 5e6 TRBC2+ HPB-ALL cells. 12 days post tumor implant, mice were engrafted with 2e6 in vitro expanded primary NK cells 2 days following NK implant (14 days post tumor implant), mice were randomized by tumor volume and dosed with 0.5 mg/kg BJM1042 or associated controls. Mice were treated with therapeutics twice a week. Tumor volume was quantified by calipers twice a week. Body weight was measured twice a week.

Figure 28A:
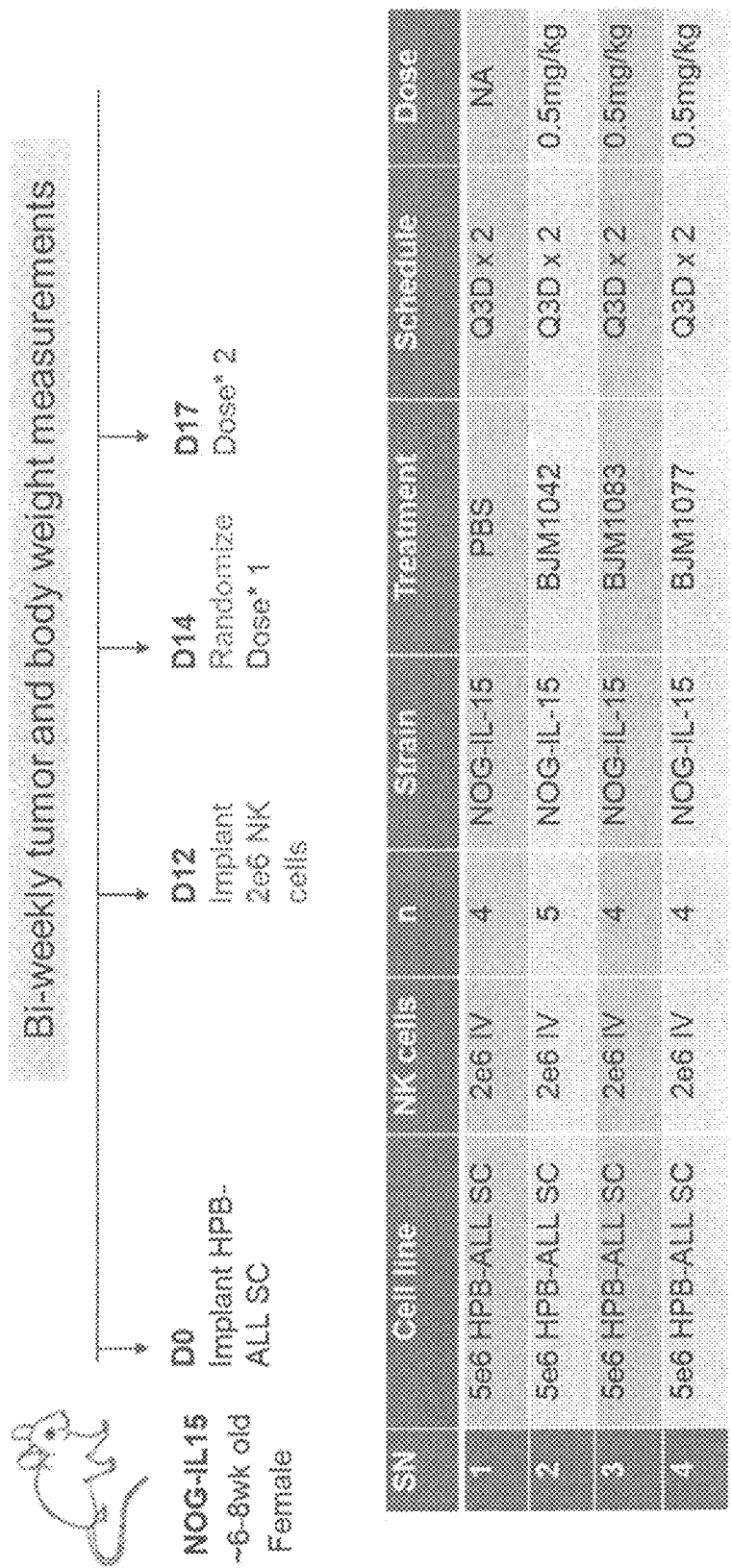
FIGS. 28A-28B are graphs from an in vivo TRBC2+ tumor study.
Figure 28B:
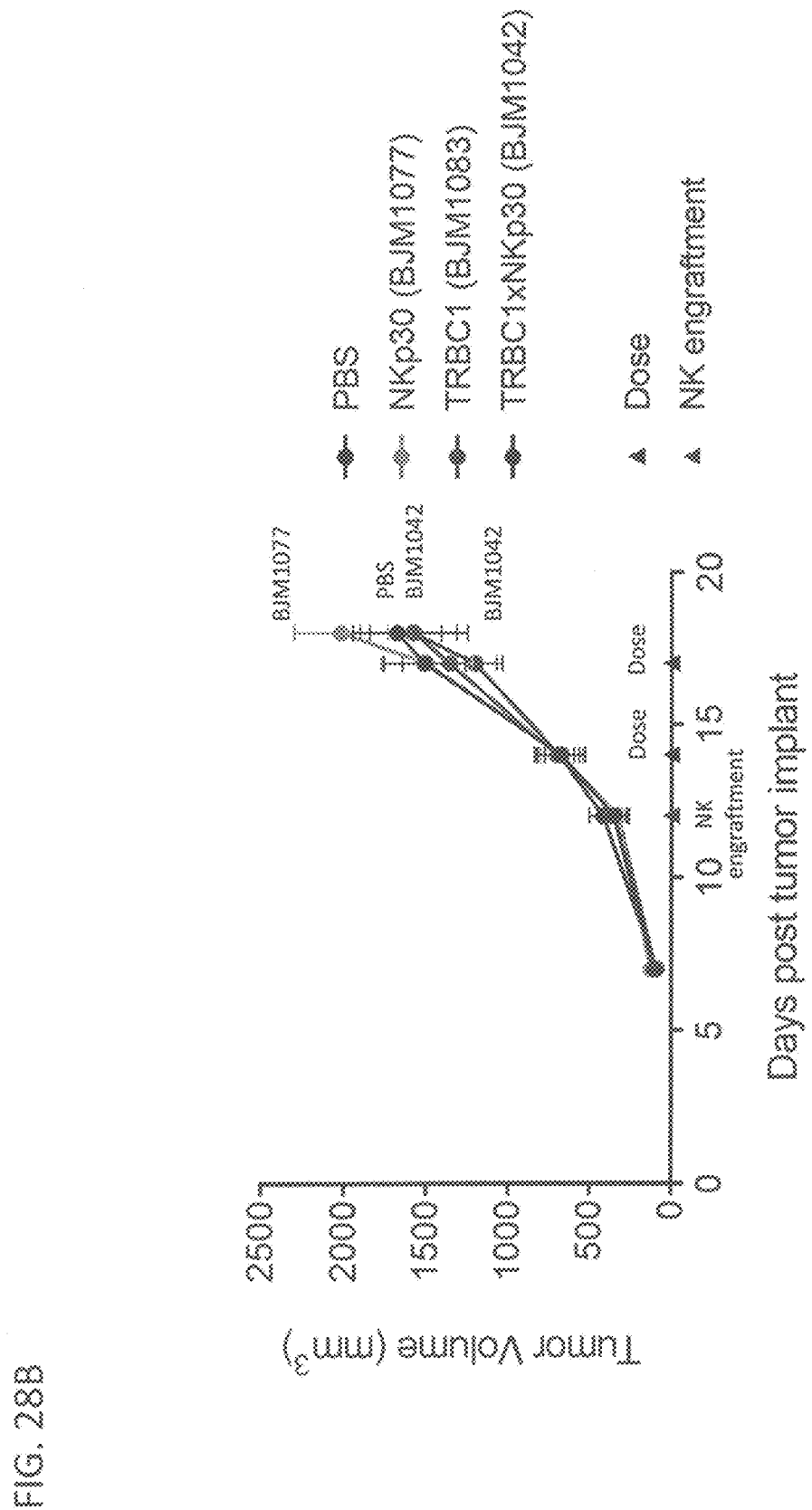

The anti-TRBC1/NKp30 antibody BJM1042, which induced regression of TRBC1-expressing H9 and Jurkat tumors, did not affect the growth of TRBC2-expressing HPB-ALL tumors (FIG. 28B). The molecules were well tolerated at the doses used and did not result in body weight loss or any other obvious adverse effects (data not shown).

Example 17: Biophysical Analysis of Anti-TRBC1/NKp30 Antibodies

The anti-TRBC1/NKp30 antibodies BJM1042 and BJM1052 were analyzed for biophysical properties. BJM1042 and BJM1052 exhibited high stability and low aggregation propensity. BJM1042 and BJM1052 showed retained binding to FcRn and reduced or negligible binding to Fcγ receptors.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (7385 sequences)

SEQ ID NO: 1 - protein, 119 aa, Artificial Sequence
  source: /note="Description of Artificial Sequence: Synthetic polypeptide"
QVQLQQSGPELVKPGTSVKISCKASGYSFTTYYIHWVKQRPGQGLEWIGWFFPGSGNIKYNEKFKGKATLTADTSSSTAYMQLSSLTSEESAVYFCAGSYYSYDVLDYWGHGTTLTVSS

SEQ ID NO: 2 - protein, 107 aa, Artificial Sequence
  source: /note="Description of Artificial Sequence: Synthetic polypeptide"
DILMTQSQKFMSTSLGDRVSVSCKASQNVGINVVWHQQKPGQSPKALIYSSSHRYSGVPDRFTGSGSGTDFTLTINNVQSEDLAEYFCQQFKSYPLTFGAGTKLELK

SEQ ID NO: 3 - protein, 10 aa, Artificial Sequence
  source: /note="Description of Artificial Sequence: Synthetic peptide"
GYSFTTYYIH

SEQ ID NO: 4 - protein, 17 aa, Artificial Sequence
  source: /note="Description of Artificial Sequence: Synthetic peptide"
WFFPGSGNIKYNEKFKG

SEQ ID NO: 5 - protein, 10 aa, Artificial Sequence
  source: /note="Description of Artificial Sequence: Synthetic peptide"
SYYSYDVLDY

SEQ ID NO: 6 - protein, 11 aa, Artificial Sequence
  source: /note="Description of Artificial Sequence: Synthetic peptide"
KASQNVGINVV

SEQ ID NO: 7 - protein, 7 aa, Artificial Sequence
  source: /note="Description of Artificial Sequence: Synthetic peptide"
SSSHRYS

SEQ ID NO: 8 - protein, 9 aa, Artificial Sequence
  source: /note="Description of Artificial Sequence: Synthetic peptide"
QQFKSYPLT

SEQ ID NO: 9 - protein, 119 aa, Artificial Sequence
  source: /note="Description of Artificial Sequence: Synthetic polypeptide"
QVQLVQSGAEVKKPGSSVKVSCKASGYSFTTYYIHWVRQAPGQGLEWMGWFFPGSGNIKYNEKFKGRVTITADTSTSTAYMELSSLRSEDTAVYYCAGSYYSYDVLDYWGQGTTVTVSS

SEQ ID NO: 10 - protein, 107 aa, Artificial Sequence
  source: /note="Description of Artificial Sequence: Synthetic polypeptide"
DIQMTQSPSFLSASVGDRVTITCKASQNVGINVVWHQQKPGKAPKALIYSSSHRYSGVPSRFSGSGSGTEFTLTISSLQPEDFATYFCQQFKSYPLTFGQGTKLEIK

SEQ ID NO: 11 - protein, 107 aa, Artificial Sequence
  source: /note="Description of Artificial Sequence: Synthetic polypeptide"
DIQMTQSPSSLSASVGDRVTITCKASQNVGINVVWHQQKPGKVPKALIYSSSHRYSGVPSRFSGSGSGTDFTLTISSLQPEDVATYFCQQFKSYPLTFGQGTKLEIK

SEQ ID NO: 12 - DNA, 357 bp, Artificial Sequence
  source: /note="Description of Artificial Sequence: Synthetic polynucleotide"
caggtgcagctggttcagtctggcgccgaagtgaagaaacctggctcctccgtgaaggtgtcctgcaaggcttccggctactccttcaccacctactacatccactgggtccgacaggcccctggacaaggattggaatggatgggctggttcttccccggctccggcaacatcaagtacaacgagaagttcaagggccgcgtgaccatcaccgccgacacctctacctctaccgcctacatggaactgtccagcctgagatctgaggacaccgccgtgtactactgcgccggctcctactactcttacgacgtgctggattactggggccagggcaccacagtgacagtgtcctct

SEQ ID NO: 13 - DNA, 321 bp, Artificial Sequence
  source: /note="Description of Artificial Sequence: Synthetic polynucleotide"
gacatccagatgacccagtctccatccttcctgtccgcctctgtgggcgacagagtgaccatcacatgcaaggcctctcagaacgtgggcatcaacgtcgtgtggcaccagcagaagcctggcaaggctcctaaggctctgatctactcctccagccaccggtactctggcgtgccctctagattttccggctctggctctggcaccgagtttaccctgacaatctccagcctgcagcctgaggacttcgccacctacttttgccagcagttcaagagctaccctctgacctttggccagggcaccaagctggaaatcaag

SEQ ID NO: 14 - DNA, 321 bp, Artificial Sequence
  source: /note="Description of Artificial Sequence: Synthetic polynucleotide"
gacatccagatgacccagtctccatcctctctgtccgcctctgtgggcgacagagtgaccatcacatgcaaggcctctcagaacgtgggcatcaacgtcgtgtggcaccagcagaaacctggcaaggtgcccaaggctctgatctactcctccagccacagatactccggcgtgccctctagattctccggctctggctctggcaccgactttaccctgacaatctccagcctgcagcctgaggacgtggccacctacttttgccagcagttcaagagctaccctctgacctttggccagggcaccaagctggaaatcaag

SEQ ID NO: 15 - protein, 117 aa, Artificial Sequence
  source: /note="Description of Artificial Sequence: Synthetic polypeptide"
DVQLVESGGGLVQPGGSRKLSCAASGFTFSNFGMHWVRQAPDKGLEWVAYISSGSSTIYYADTLKGRFTISRDNPKNTLFLQMTSLRSEDTAMYYCARRGEGAMDYWGQGTSVTVSS

SEQ ID NO: 16 - protein, 106 aa, Artificial Sequence
  source: /note="Description of Artificial Sequence: Synthetic polypeptide"
ENVLTQSPAIMSASLGEKVTMSCRASSSVNYIYWYQQKSDASPKLWIYYTSNLAPGVPTRFSGSGSGNSYSLTISSMEGEDAATYYCQQFTSSPFTFGSGTKLEIK

SEQ ID NO: 17 - protein, 10 aa, Artificial Sequence
  source: /note="Description of Artificial Sequence: Synthetic peptide"
GFTFSNFGMH

SEQ ID NO: 18 - protein, 17 aa, Artificial Sequence
  source: /note="Description of Artificial Sequence: Synthetic peptide"
YISSGSSTIYYADTLKG

SEQ ID NO: 19 - protein, 8 aa, Artificial Sequence
  source: /note="Description of Artificial Sequence: Synthetic peptide"
RGEGAMDY

SEQ ID NO: 20 - protein, 10 aa, Artificial Sequence
  source: /note="Description of Artificial Sequence: Synthetic peptide"
RASSSVNYIY

SEQ ID NO: 21 - protein, 7 aa, Artificial Sequence
  source: /note="Description of Artificial Sequence: Synthetic peptide"
YTSNLAP

SEQ ID NO: 22 - protein, 9 aa, Artificial Sequence
  source: /note="Description of Artificial Sequence: Synthetic peptide"
QQFTSSPFT

SEQ ID NO: 23 - protein, 117 aa, Artificial Sequence
  source: /note="Description of Artificial Sequence: Synthetic polypeptide"
EVQLVESGGGLVQPGGSLRLSCAASGFTFSNFGMHWVRQAPGKGLEWVSYISSGSSTIYYADTLKGRFTISRDNAKNSLYLQMNSLRAEDTAVYYCARRGEGAMDYWGQGTTVTVSS

SEQ ID NO: 24 - protein, 117 aa, Artificial Sequence
  source: /note="Description of Artificial Sequence: Synthetic polypeptide"
EVQLVESGGGLVQPGGSLRLSCAASGFTFSNFGMHWVRQAPGKGLEWVSYISSGSSTIYYADTLKGRFTISRDNSKNTLYLQMNSLRAEDTAVYYCARRGEGAMDYWGQGTTVTVSS

SEQ ID NO: 25 - protein, 117 aa, Artificial Sequence
  source: /note="Description of Artificial Sequence: Synthetic polypeptide"
QVQLVESGGGVVQPGRSLRLSCAASGFTFSNFGMHWVRQAPGKGLEWVAYISSGSSTIYYADTLKGRFTISRDNSKNTLYLQMNSLRAEDTAVYYCARRGEGAMDYWGQGTTVTVSS

SEQ ID NO: 26 - protein, 106 aa, Artificial Sequence
  source: /note="Description of Artificial Sequence: Synthetic polypeptide"
DNQLTQSPSFLSASVGDRVTITCRASSSVNYIYWYQQKPGKAPKLLIYYTSNLAPGVPSRFSGSGSGNEYTLTISSLQPEDFATYYCQQFTSSPFTFGQGTKLEIK

SEQ ID NO: 27 - protein, 106 aa, Artificial Sequence
  source: /note="Description of Artificial Sequence: Synthetic polypeptide"
DNQLTQSPSSLSASVGDRVTITCRASSSVNYIYWYQQKPGKAPKLLIYYTSNLAPGVPSRFSGSGSGNDYTLTISSLQPEDFATYYCQQFTSSPFTFGQGTKLEIK

SEQ ID NO: 28 - protein, 106 aa, Artificial Sequence
  source: /note="Description of Artificial Sequence: Synthetic polypeptide"
ENVLTQSPATLSVSPGERATLSCRASSSVNYIYWYQQKPGQAPRLLIYYTSNLAPGIPARFSGSGSGNEYTLTISSLQSEDFAVYYCQQFTSSPFTFGQGTKLEIK

SEQ ID NO: 29 - protein, 105 aa, Artificial Sequence
  source: /note="Description of Artificial Sequence: Synthetic polypeptide"
QNVLTQPPSASGTPGQRVTISCRASSSVNYIYWYQQLPGTAPKLLIYYTSNLAPGVPDRFSGSGSGNSYSLAISGLRSEDEADYYCQQFTSSPFTFGTGTKVTVL

SEQ ID NO: 30 - protein, 105 aa, Artificial Sequence
  source: /note="Description of Artificial Sequence: Synthetic polypeptide"
SNELTQPPSVSVSPGQTARITCRASSSVNYIYWYQQKSGQAPVLVIYYTSNLAPGIPERFSGSGSGNMYTLTISGAQVEDEADYYCQQFTSSPFTFGTGTKVTVL

SEQ ID NO: 31 - DNA, 351 bp, Artificial Sequence
  source: /note="Description of Artificial Sequence: Synthetic polynucleotide"
gaggtgcagctggttgaatctggcggaggattggttcagcctggcggctctctgagactgtcttgtgccgcttctggcttcaccttctccaacttcggcatgcactgggtccgacaggcccctggaaaaggactggaatgggtgtcctacatctcctccggctcctccaccatctactacgctgacaccctgaagggcagattcaccatctctcgggacaacgccaagaactccctgtacctgcagatgaacagcctgagagccgaggacaccgccgtgtactactgtgctagaagaggcgagggcgccatggattattggggccagggaaccacagtgaccgtgtctagc

SEQ ID NO: 32 - DNA, 351 bp, Artificial Sequence
  source: /note="Description of Artificial Sequence: Synthetic polynucleotide"
gaggtgcagctggttgaatctggcggaggattggttcagcctggcggctctctgagactgtcttgtgccgcttctggcttcaccttctccaacttcggcatgcactgggtccgacaggcccctggaaaaggactggaatgggtgtcctacatctcctccggctcctccaccatctactacgctgacaccctgaagggcagattcaccatcagccgggacaactccaagaacaccctgtacctgcagatgaactccctgagagccgaggacaccgccgtgtactactgtgctagaagaggcgagggcgccatggattattggggccagggaaccacagtgaccgtgtctagc

SEQ ID NO: 33 - DNA, 351 bp, Artificial Sequence
  source: /note="Description of Artificial Sequence: Synthetic polynucleotide"
caggtgcagctggtggaatctggtggcggagttgtgcagcctggcagatccctgagactgtcttgtgccgcctctggcttcaccttctccaacttcggcatgcactgggtccgacaggcccctggaaaaggattggagtgggtcgcctacatctcctccggctcctccaccatctactacgctgacaccctgaagggcagattcaccatcagccgggacaactccaagaacaccctgtacctgcagatgaactccctgagagccgaggacaccgccgtgtactactgtgctagaagaggcgagggcgccatggattattggggccagggaaccacagtgaccgtgtctagc

SEQ ID NO: 34 - DNA, 318 bp, Artificial Sequence
  source: /note="Description of Artificial Sequence: Synthetic polynucleotide"
gataaccagctgacccagtctcctagcttcctgtctgcctctgtgggcgacagagtgacaattacctgccgggcctcctcctccgtgaactacatctactggtatcagcagaagcccggcaaggcccctaagctgctgatctactacacctccaatctggcccctggcgtgccctctagattttccggatctggctccggcaacgagtataccctgacaatctccagcctgcagcctgaggacttcgccacctactactgccagcagttcacctcctctccattcacctttggccagggcaccaagctggaaatcaaa

SEQ ID NO: 35 - DNA, 317 bp, Artificial Sequence
  source: /note="Description of Artificial Sequence: Synthetic polynucleotide"
ataaccagctgacccagtctccttccagcctgtctgcttctgtgggcgacagagtgacaattacctgccgggcctcctcctccgtgaactacatctactggtatcagcagaagcccggcaaggcccctaagctgctgatctactacacctccaatctggcccctggcgtgccctctagattttccggatctggctccggcaacgactataccctgacaatctccagcctgcagcctgaggacttcgccacctactactgccagcagttcacctcctctccattcacctttggccagggcaccaagctggaaatcaaa

SEQ ID NO: 36 - DNA, 318 bp, Artificial Sequence
  source: /note="Description of Artificial Sequence: Synthetic polynucleotide"
gagaatgtgctgacccagtctcctgccacactgtctgttagccctggcgagagagctaccctgagctgcagagcctcttcctccgtgaactacatctactggtatcagcagaagcccggccaggctcctagactgctgatctactacacctccaatctggcccctggcatccctgccagattttccggatctggctccggcaacgagtataccctgaccatctccagcctgcagtccgaggactttgctgtgtactattgccagcagttcacaagcagccctttcacctttggccagggcaccaagctggaaatcaaa

SEQ ID NO: 37 - DNA, 315 bp, Artificial Sequence
  source: /note="Description of Artificial Sequence: Synthetic polynucleotide"
cagaatgtgctgacccaacctccttccgcctctggcacacctggacagagagtgacaatctcctgccgggcctcctcctccgtgaactacatctactggtatcagcagctgcccggcaccgctcctaaactgctgatctactacacctccaatctggcccctggcgtgcccgatagattttccggatctggctccggcaactcctacagcctggctatctctggcctgagatctgaggacgaggccgactactactgccagcagttcacctcctctccattcacctttggcaccggcaccaaagtgacagttctt

SEQ ID NO: 38 - DNA, 315 bp, Artificial Sequence
  source: /note="Description of Artificial Sequence: Synthetic polynucleotide"
tctaatgagctgacccagcctccttccgtgtccgtgtctcctggacagaccgccagaattacctgccgggcctcctcctccgtgaactacatctactggtatcagcagaagtccggccaggctcctgtgctcgtgatctactacacctccaatctggcccctggcatccctgagagattctccggatctggctccggcaacatgtacaccctgaccatctctggcgcccaggtggaagatgaggccgactactactgccagcagttcacctcctctccattcacctttggcaccggcaccaaagtgacagttctt

SEQ ID NO: 39 - protein, 107 aa, Homo sapiens [sequence omitted]

SEQ ID NO: 40 - protein, 326 aa, Artificial Sequence
  source: /note="Description of Artificial Sequence: Synthetic polypeptide"
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 41 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 330 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - DNA, 344 bp, Artificial Sequence
  source: /note="Description of Artificial Sequence: Synthetic polynucleotide"
atgagcatcggcctcctgtgctgtgcagccttgtctctcctgtgggcaggtccagtgaatgctggtgtcactcagaccccaaaattccaggtcctgaagacaggacagagcatgacactgcagtgtgcccaggatatgaaccatgaatacatgtcctggtatcgacaagacccaggcatggggctgaggctgattcattactcagttggtgctggtatcactgaccaaggagaagtccccaatggctacaatgtctccagatcaaccacagaggatttcccgctcaggctgctgtcggctgctccctcccagacatctgtgtacttctgtgccagcagttactc

SEQ ID NO: 44 - protein, 114 aa, Artificial Sequence
  source: /note="Description of Artificial Sequence: Synthetic polypeptide"
MSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCASSY

SEQ ID NO: 45 - protein, 5 aa, Artificial Sequence
  source: /note="Description of Artificial Sequence: Synthetic peptide"
TYYIH

SEQ ID NO: 46 - protein, 17 aa, Artificial Sequence
  source: /note="Description of Artificial Sequence: Synthetic peptide"
WFFPGSGNIKYNEKFKG

SEQ ID NO: 47 - protein, 10 aa, Artificial Sequence
  source: /note="Description of Artificial Sequence: Synthetic peptide"
SYYSYDVLDY

SEQ ID NO: 48 - protein, 7 aa, Artificial Sequence
  source: /note="Description of Artificial Sequence: Synthetic peptide"
GYSFTTY

SEQ ID NO: 49 - protein, 6 aa, Artificial Sequence
  source: /note="Description of Artificial Sequence: Synthetic peptide"
FPGSGN

SEQ ID NO: 50 - protein, 10 aa, Artificial Sequence
  source: /note="Description of Artificial Sequence: Synthetic peptide"
SYYSYDVLDY

SEQ ID NO: 51 - protein, 11 aa, Artificial Sequence
  source: /note="Description of Artificial Sequence: Synthetic peptide"
KASQNVGINVV

SEQ ID NO: 52 - protein, 7 aa, Artificial Sequence
  source: /note="Description of Artificial Sequence: Synthetic peptide"
SSSHRYS

SEQ ID NO: 53 - protein, 9 aa, Artificial Sequence
  source: /note="Description of Artificial Sequence: Synthetic peptide"
QQFKSYPLT

SEQ ID NO: 54 - protein, 11 aa, Artificial Sequence
  source: /note="Description of Artificial Sequence: Synthetic peptide"
KASQNVGINVV

SEQ ID NO: 55 - protein, 7 aa, Artificial Sequence
  source: /note="Description of Artificial Sequence: Synthetic peptide"
SSSHRYS

SEQ ID NO: 56 - protein, 9 aa, Artificial Sequence
  source: /note="Description of Artificial Sequence: Synthetic peptide"
QQFKSYPLT

SEQ ID NO: 57 - protein, 5 aa, Artificial Sequence
  source: /note="Description of Artificial Sequence: Synthetic peptide"
NFGMH

SEQ ID NO: 58 - protein, 17 aa, Artificial Sequence
  source: /note="Description of Artificial Sequence: Synthetic peptide"
YISSGSSTIYYADTLKG

SEQ ID NO: 59 - protein, 8 aa, Artificial Sequence
  source: /note="Description of Artificial Sequence: Synthetic peptide"
RGEGAMDY

SEQ ID NO: 60 - protein, 7 aa, Artificial Sequence
  source: /note="Description of Artificial Sequence: Synthetic peptide"
GFTFSNF

SEQ ID NO: 61 - protein, 6 aa, Artificial Sequence
  source: /note="Description of Artificial Sequence: Synthetic peptide"
SSGSST

SEQ ID NO: 62 - protein, 8 aa, Artificial Sequence
  source: /note="Description of Artificial Sequence: Synthetic peptide"
RGEGAMDY

SEQ ID NO: 63 - protein, 10 aa, Artificial Sequence
  source: /note="Description of Artificial Sequence: Synthetic peptide"
RASSSVNYIY

SEQ ID NO: 64 - protein, 7 aa, Artificial Sequence
  source: /note="Description of Artificial Sequence: Synthetic peptide"
YTSNLAP

SEQ ID NO: 65 - protein, 9 aa, Artificial Sequence
  source: /note="Description of Artificial Sequence: Synthetic peptide"
QQFTSSPFT

SEQ ID NO: 66 - protein, 10 aa, Artificial Sequence
  source: /note="Description of Artificial Sequence: Synthetic peptide"
RASSSVNYIY

SEQ ID NO: 67 - protein, 7 aa, Artificial Sequence
  source: /note="Description of Artificial Sequence: Synthetic peptide"
YTSNLAP

SEQ ID NO: 68 - protein, 9 aa, Artificial Sequence
  source: /note="Description of Artificial Sequence: Synthetic peptide"
QQFTSSPFT

SEQ ID NO: 69-74 - skipped (6 entries)

SEQ ID NO: 75 - protein, 14 aa, Artificial Sequence
  source: /note="Description of Artificial Sequence: Synthetic peptide"
AEAAAKEAAAKAAA

SEQ ID NO: 76 - protein, 19 aa, Artificial Sequence
  source: /note="Description of Artificial Sequence: Synthetic peptide"
AEAAAKEAAAKEAAAKAAA

SEQ ID NO: 77 - protein, 24 aa, Artificial Sequence
  source: /note="Description of Artificial Sequence: Synthetic peptide"
AEAAAKEAAAKEAAAKEAAAKAAA

SEQ ID NO: 78 - protein, 29 aa, Artificial Sequence
  source: /note="Description of Artificial Sequence: Synthetic peptide"
AEAAAKEAAAKEAAAKEAAAKEAAAKAAA

SEQ ID NO: 79-91 - skipped (13 entries)

SEQ ID NO: 92 - protein, 390 aa, Homo sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 93 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 94 - protein, 412 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 95 - protein, 503 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 96 - protein, 507 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 97 - protein, 426 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 98 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 99 - protein, 592 aa, Homo sapiens
MGRGLLRGLWPLHIVLWTRIASTIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 100 - protein, 137 aa, Homo sapiens
TIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 101 - protein, 136 aa, Homo sapiens
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 102 - protein, 162 aa, Homo sapiens
TIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 103 - protein, 101 aa, Homo sapiens
QLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIF

SEQ ID NO: 104 - protein, 93 aa, Homo sapiens
LQCFCHLCTKDNFTCVTDGLCFVSVTETTDKVIHNSMCIAEIDLIPRDRPFVCAPSSKTGSVTTTYCCNQDHCNKIELPTTVKSSPGLGPVEL

SEQ ID NO: 105 - protein, 79 aa, Homo sapiens
ALQCFCHLCTKDNFTCVTDGLCFVSVTETTDKVIHNSMCIAEIDLIPRDRPFVCAPSSKTGSVTTTYCCNQDHCNKIEL

SEQ ID NO: 106 - protein, 851 aa, Homo sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 107 - protein, 850 aa, Homo sapiens
MTSHYVIAIFALMSSCLATAGPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 108 - protein, 767 aa, Homo sapiens
GPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTV

SEQ ID NO: 109-116 - skipped (8 entries)

SEQ ID NO: 117 - protein, 361 aa, Homo sapiens
LSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 118 - protein, 394 aa, Homo sapiens
LSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 119 - protein, 389 aa, Homo sapiens
LSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 120 - protein, 470 aa, Homo sapiens
LQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 121 - protein, 474 aa, Homo sapiens
LQCFCHLCTKDNFTCVTDGLCFVSVTETTDKVIHNSMCIAEIDLIPRDRPFVCAPSSKTGSVTTTYCCNQDHCNKIELPTTGPFSVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 122 - protein, 393 aa, Homo sapiens
LQCFCHLCTKDNFTCVTDGLCFVSVTETTDKVIHNSMCIAEIDLIPRDRPFVCAPSSKTGSVTTTYCCNQDHCNKIELPTTGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 123 - protein, 545 aa, Homo sapiens
TIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 124 - protein, 570 aa, Homo sapiens
TIPPHVQKSDVEMEAQKDEIICPSCNRTAHPLRHINNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENVESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 125 - protein, 831 aa, Homo sapiens
GPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 126 - protein, 830 aa, Homo sapiens
GPEPGALCELSPVSASHPVQALMESFTVLSGCASRGTTGLPQEVHVLNLRTAGQGPGQLQREVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGETAGRQQVPTSPPASENSSAAHSIGSTQSTPCSSSSTA

SEQ ID NO: 127-191 - skipped (65 entries)

SEQ ID NO: 192 - protein, 481 aa, Artificial Sequence
  source: /note="Description of Artificial Sequence: Synthetic polypeptide"
  VARIANT (330)..(330): /replace=" "
  SITE (1)..(481): /note="Variant residues given in the sequence have no preference with respect to those in the annotations for variant positions"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 193 - protein, 481 aa, Artificial Sequence
  source: /note="Description of Artificial Sequence: Synthetic polypeptide"
  VARIANT (330)..(330): /replace=" "
  SITE (1)..(481): /note="Variant residues given in the sequence have no preference with respect to those in the annotations for variant positions"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 194 - protein, 378 aa, Artificial Sequence
  source: /note="Description of Artificial Sequence: Synthetic polypeptide"
  VARIANT (227)..(227): /replace=" "
  SITE (1)..(378): /note="Variant residues given in the sequence have no preference with respect to those in the annotations for variant positions"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 195 - protein, 378 aa, Artificial Sequence
  source: /note="Description of Artificial Sequence: Synthetic polypeptide"
  VARIANT (227)..(227): /replace=" "
  SITE (1)..(378): /note="Variant residues given in the sequence have no preference with respect to those in the annotations for variant positions"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPD

SEQ ID NO: 196 - protein, 481 aa, Artificial Sequence
  source: /note="Description of Artificial Sequence: Synthetic polypeptide"
  VARIANT (481)..(481): /replace=" "
  SITE (1)..(481): /note="Variant residues given in the sequence have no preference with respect to those in the annotations for variant positions"
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 197 - protein, 481 aa, Artificial Sequence
  source: /note="Description of Artificial Sequence: Synthetic polypeptide"
  VARIANT (481)..(481): /replace=" "
  SITE (1)..(481): /note="Variant residues given in the sequence have no preference with respect to those in the annotations for variant positions"
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - protein, 257 aa, Artificial Sequence
  source: /note="Description of Artificial Sequence: Synthetic polypeptide"
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 199 - protein, 258 aa, Artificial Sequence
  source: /note="Description of Artificial Sequence: Synthetic polypeptide"
IPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDGGGGSGGGGSGGGGSRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200 - protein, 7 aa, Artificial Sequence
  source: /note="Description of Artificial Sequence: Synthetic peptide"
FTGYVMH

SEQ ID NO: 201 - protein, 17 aa, Artificial Sequence
  source: /note="Description of Artificial Sequence: Synthetic peptide"
FINPYNDDIQSNERFRG

SEQ ID NO: 202 - protein, 15 aa, Artificial Sequence
  source: /note="Description of Artificial Sequence: Synthetic peptide"
GAGYNFDGAYRFFDF

SEQ ID NO: 203 - protein, 28 aa, Artificial Sequence
  source: /note="Description of Artificial Sequence: Synthetic peptide"
EVRLQQSGPDLIKPGASVKMSCKASGYT

SEQ ID NO: 204 - protein, 14 aa, Artificial Sequence
  source: /note="Description of Artificial Sequence: Synthetic peptide"
WVKQRPGQGLEWIG

SEQ ID NO: 205 - protein, 32 aa, Artificial Sequence
  source: /note="Description of Artificial Sequence: Synthetic polypeptide"
KATLTSDKSSTTAYMELSSLTSEDSAVYYCAR

SEQ ID NO: 206 - protein, 11 aa, Artificial Sequence
  source: /note="Description of Artificial Sequence: Synthetic peptide"
WGQGTTLTVSS

SEQ ID NO: 207 - protein, 28 aa, Artificial Sequence
  source: /note="Description of Artificial Sequence: Synthetic peptide"
QVQLVQSGAEVKKPGASVKVSCKASGYT

SEQ ID NO: 208 - protein, 14 aa, Artificial Sequence
  source: /note="Description of Artificial Sequence: Synthetic peptide"
WVRQAPGQGLEWMG

SEQ ID NO: 209 - protein, 32 aa, Artificial Sequence
  source: /note="Description of Artificial Sequence: Synthetic polypeptide"
RVTMTSDKSTTTAYMELSSLRSEDTAVYYCAR

SEQ ID NO: 210 - protein, 11 aa, Artificial Sequence
  source: /note="Description of Artificial Sequence: Synthetic peptide"
WGQGTLVTVSS

SEQ ID NO: 211 - protein, 28 aa, Artificial Sequence
  source: /note="Description of Artificial Sequence: Synthetic peptide"
QVQLVQSGAEVKKPGASVKVSCKASGYT

SEQ ID NO: 212 - protein, 14 aa, Artificial Sequence
  source: /note="Description of Artificial Sequence: Synthetic peptide"
WVRQAPGQGLEWMG

SEQ ID NO: 213 - protein, 32 aa, Artificial Sequence
  source: /note="Description of Artificial Sequence: Synthetic polypeptide"
WVTMTSDKSITTAYMELSRLRSDDTAVYYCAR

SEQ ID NO: 214 - protein, 11 aa, Artificial Sequence
  source: /note="Description of Artificial Sequence: Synthetic peptide"
WGQGTLVTVSS

SEQ ID NO: 215 - protein, 28 aa, Artificial Sequence
  source: /note="Description of Artificial Sequence: Synthetic peptide"
QVQLVQSGAEVKKPGSSVKVSCKASGYT

SEQ ID NO: 216 - protein, 14 aa, Artificial Sequence
  source: /note="Description of Artificial Sequence: Synthetic peptide"
WVRQAPGQGLEWMG

SEQ ID NO: 217 - protein, 32 aa, Artificial Sequence
  source: /note="Description of Artificial Sequence: Synthetic polypeptide"
RVTITSDKSTTTAYMELSSLRSEDTAVYYCAR

SEQ ID NO: 218 - protein, 11 aa, Artificial Sequence
  source: /note="Description of Artificial Sequence: Synthetic peptide"
WGQGTLVTVSS

SEQ ID NO: 219 - protein, 28 aa, Artificial Sequence
  source: /note="Description of Artificial Sequence: Synthetic peptide"
QVQLVQSGAEVKKPGASVKVSCKASGYT

SEQ ID NO: 220 - protein, 14 aa, Artificial Sequence
  source: /note="Description of Artificial Sequence: Synthetic peptide"
WVRQAPGQRLEWMG

SEQ ID NO: 221 - protein, 32 aa, Artificial Sequence
  source: /note="Description of Artificial Sequence: Synthetic polypeptide"
RVTITSDKSATTAYMELSSLRSEDTAVYYCAR

SEQ ID NO: 222 - protein, 11 aa, Artificial Sequence
  source: /note="Description of Artificial Sequence: Synthetic peptide"
WGQGTLVTVSS

SEQ ID NO: 223 - protein, 16 aa, Artificial Sequence
  source: /note="Description of Artificial Sequence: Synthetic peptide"
RSSQRLVHSNGNTYLH

SEQ ID NO: 224 - protein, 7 aa, Artificial Sequence
  source: /note="Description of Artificial Sequence: Synthetic peptide"
RVSNRFP

SEQ ID NO: 225 - protein, 9 aa, Artificial Sequence
  source: /note="Description of Artificial Sequence: Synthetic peptide"
SQSTHVPYT

SEQ ID NO: 226 - protein, 23 aa, Artificial Sequence
  source: /note="Description of Artificial Sequence: Synthetic peptide"
DVVMTQSPLSLPVSLGDQASISC

SEQ ID NO: 227 - protein, 15 aa, Artificial Sequence
  source: /note="Description of Artificial Sequence: Synthetic peptide"
WYLQKPGQSPKLLIY

SEQ ID NO: 228 - protein, 32 aa, Artificial Sequence
  source: /note="Description of Artificial Sequence: Synthetic polypeptide"
GVPDRFSGSGSGTDFTLKISRVEAEDLGIYFC

SEQ ID NO: 229 - protein, 10 aa, Artificial Sequence
  source: /note="Description of Artificial Sequence: Synthetic peptide"
FGGGTKLEIK

SEQ ID NO: 230 - protein, 23 aa, Artificial Sequence
  source: /note="Description of Artificial Sequence: Synthetic peptide"
DVVMTQSPLSLPVTPGEPASISC

SEQ ID NO: 231 - protein, 15 aa, Artificial Sequence
  source: /note="Description of Artificial Sequence: Synthetic peptide"
WYLQKPGQSPQLLIY

SEQ ID NO: 232 - protein, 32 aa, Artificial Sequence
  source: /note="Description of Artificial Sequence: Synthetic polypeptide"
GVPDRFSGSGSGTDFTLKISRVEAEDVGVYFC

SEQ ID NO: 233 - protein, 10 aa, Artificial Sequence
  source: /note="Description of Artificial Sequence: Synthetic peptide"
FGGGTKVEIK

SEQ ID NO: 234 - protein, 23 aa, Artificial Sequence
  source: /note="Description of Artificial Sequence: Synthetic peptide"
EVVMTQSPGTLSLSPGERATLSC

SEQ ID NO: 235 - protein, 15 aa, Artificial Sequence
  source: /note="Description of Artificial Sequence: Synthetic peptide"
WYQQKPGQAPRLLIY

SEQ ID NO: 236 - protein, 32 aa, Artificial Sequence
  source: /note="Description of Artificial Sequence: Synthetic polypeptide"
GIPDRFSGSGSGTDFTLTISRLEPEDFAVYFC

SEQ ID NO: 237 - protein, 10 aa, Artificial Sequence
  source: /note="Description of Artificial Sequence: Synthetic peptide"
FGGGTKVEIK

SEQ ID NO: 238 - protein, 23 aa, Artificial Sequence
  source: /note="Description of Artificial Sequence: Synthetic peptide"
DVVMTQSPLSLPVTLGQPASISC

SEQ ID NO: 239 - protein, 15 aa, Artificial Sequence
  source: /note="Description of Artificial Sequence: Synthetic peptide"
WYQQRPGQSPRLLIY

SEQ ID NO: 240 - protein, 32 aa, Artificial Sequence; identical to SEQ ID NO: 232
  source: /note="Description of Artificial Sequence: Synthetic polypeptide"

SEQ ID NO: 241 - protein, 10 aa, Artificial Sequence
  source: /note="Description of Artificial Sequence: Synthetic peptide"
FGGGTKVEIK

SEQ ID NO: 242 - protein, 23 aa, Artificial Sequence
  source: /note="Description of Artificial Sequence: Synthetic peptide"
DVVMTQTPLSLPVTPGEPASISC

SEQ ID NO: 243 - protein, 15 aa, Artificial Sequence
  source: /note="Description of Artificial Sequence: Synthetic peptide"
WYLQKPGQSPQLLIY

SEQ ID NO: 244 - protein, 32 aa, Artificial Sequence; identical to SEQ ID NO: 232
  source: /note="Description of Artificial Sequence: Synthetic polypeptide"

SEQ ID NO: 245 - protein, 10 aa, Artificial Sequence
  source: /note="Description of Artificial Sequence: Synthetic peptide"
FGGGTKVEIK

SEQ ID NO: 246 - protein, 23 aa, Artificial Sequence
  source: /note="Description of Artificial Sequence: Synthetic peptide"
DVVMTQTPLSLSVTPGQPASISC

SEQ ID NO: 247 - protein, 15 aa, Artificial Sequence
  source: /note="Description of Artificial Sequence: Synthetic peptide"
WYLQKPGQSPQLLIY

SEQ ID NO: 248 - protein, 32 aa, Artificial Sequence; identical to SEQ ID NO: 232
  source: /note="Description of Artificial Sequence: Synthetic polypeptide"

SEQ ID NO: 249 - protein, 10 aa, Artificial Sequence
  source: /note="Description of Artificial Sequence: Synthetic peptide"
FGGGTKVEIK

SEQ ID NO: 250 - protein, 124 aa, Artificial Sequence
  source: /note="Description of Artificial Sequence: Synthetic polypeptide"
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSS

SEQ ID NO: 251 - protein, 124 aa, Artificial Sequence
  source: /note="Description of Artificial Sequence: Synthetic polypeptide"
QVQLVQSGAEVKKPGASVKVSCKASGYTFTGYVMHWVRQAPGQGLEWMGFINPYNDDIQSNERFRGRVTMTSDKSTTTAYMELSSLRSEDTAVYYCARGAGYNFDGAYRFFDFWGQGTLVTVSS

SEQ ID NO: 252 - protein, 124 aa, Artificial Sequence
  source: /note="Description of Artificial Sequence: Synthetic polypeptide"
QVQLVQSGAEVKKPGASVKVSCKASGYTFTGYVMHWVRQAPGQGLEWMGFINPYNDDIQSNERFRGWVTMTSDKSITTAYMELSRLRSDDTAVYYCARGAGYNFDGAYRFFDFWGQGTLVTVSS

SEQ ID NO: 253 - protein, 124 aa, Artificial Sequence
  source: /note="Description of Artificial Sequence: Synthetic polypeptide"
QVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSS

SEQ ID NO: 254 - protein, 124 aa, Artificial Sequence
  source: /note="Description of Artificial Sequence: Synthetic polypeptide"
QVQLVQSGAEVKKPGASVKVSCKASGYTFTGYVMHWVRQAPGQRLEWMGFINPYNDDIQSNERFRGRVTITSDKSATTAYMELSSLRSEDTAVYYCARGAGYNFDGAYRFFDFWGQGTLVTVSS

SEQ ID NO: 255 - protein, 112 aa, Artificial Sequence
  source: /note="Description of Artificial Sequence: Synthetic polypeptide"
DVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIK

SEQ ID NO: 256 - protein, 112 aa, Artificial Sequence
  source: /note="Description of Artificial Sequence: Synthetic polypeptide"
DVVMTQSPLSLPVTPGEPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIK

SEQ ID NO: 257 - protein, 112 aa, Artificial Sequence
  source: /note="Description of Artificial Sequence: Synthetic polypeptide"
EVVMTQSPGTLSLSPGERATLSCRSSQRLVHSNGNTYLHWYQQKPGQAPRLLIYRVSNRFPGIPDRFSGSGSGTDFTLTISRLEPEDFAVYFCSQSTHVPYTFGGGTKVEIK

SEQ ID NO: 258 - protein, 112 aa, Artificial Sequence
  source: /note="Description of Artificial Sequence: Synthetic polypeptide"
DVVMTQSPLSLPVTLGQPASISCRSSQRLVHSNGNTYLHWYQQRPGQSPRLLIYRVSNRFPGVPDRFSGSGSGTDFTLKISRVEAEDVGVYFCSQSTHVPYTFGGGTKVEIK

SEQ ID NO: 259 - protein, 112 aa, Artificial Sequence
  source: /note="Description of Artificial Sequence: Synthetic polypeptide"
DVVMTQTPLSLPVTPGEPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIK

SEQ ID NO: 260 - protein, 112 aa, Artificial Sequence
  source: /note="Description of Artificial Sequence: Synthetic polypeptide"
DVVMTQTPLSLSVTPGQPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIK

SEQ ID NO: 261-5999 - skipped (5739 entries)

SEQ ID NO: 6000 - protein, 7 aa, Artificial Sequence
  source: /note="Description of Artificial Sequence: Synthetic peptide"
TGGYHWN

SEQ ID NO: 6001 - protein, 16 aa, Artificial Sequence
  source: /note="Description of Artificial Sequence: Synthetic peptide"
YIYSSGSTSYNPSLKS

SEQ ID NO: 6002 - protein, 8 aa, Artificial Sequence
  source: /note="Description of Artificial Sequence: Synthetic peptide"
GNWHYFDF

SEQ ID NO: 6003 - protein, 30 aa, Artificial Sequence
  source: /note="Description of Artificial Sequence: Synthetic polypeptide"
QIQLQESGPGLVKPSQSLSLTCSVTGFSIN

SEQ ID NO: 6004 - protein, 14 aa, Artificial Sequence
  source: /note="Description of Artificial Sequence: Synthetic peptide"
WIRQFPGKKLEWMG

SEQ ID NO: 6005 - protein, 32 aa, Artificial Sequence
  source: /note="Description of Artificial Sequence: Synthetic polypeptide"
RISITRDTSKNQFFLQLNSVTTEDTATYYCAR

SEQ ID NO: 6006 - protein, 11 aa, Artificial Sequence
  source: /note="Description of Artificial Sequence: Synthetic peptide"
WGQGTMVTVSS

SEQ ID NO: 6007 - protein, 7 aa, Artificial Sequence
  source: /note="Description of Artificial Sequence: Synthetic peptide"
TGGYHWN

SEQ ID NO: 6008 - protein, 16 aa, Artificial Sequence
  source: /note="Description of Artificial Sequence: Synthetic peptide"
YIYSSGTTRYNPSLKS

SEQ ID NO: 6009 - protein, 8 aa, Artificial Sequence
  source: /note="Description of Artificial Sequence: Synthetic peptide"
GNWHYFDY

SEQ ID NO: 6010 - protein, 30 aa, Artificial Sequence; identical to SEQ ID NO: 6003
  source: /note="Description of Artificial Sequence: Synthetic polypeptide"

SEQ ID NO: 6011 - protein, 14 aa, Artificial Sequence
  source: /note="Description of Artificial Sequence: Synthetic peptide"
WIRQFPGKKLEWMG

SEQ ID NO: 6012 - protein, 32 aa, Artificial Sequence
  source: /note="Description of Artificial Sequence: Synthetic polypeptide"
RISITRDTSKNQFFLQLNSVTPEDTATYYCTR

SEQ ID NO: 6013 - protein, 11 aa, Artificial Sequence
  source: /note="Description of Artificial Sequence: Synthetic peptide"
WGQGTLVAVSS

SEQ ID NO: 6014 - protein, 30 aa, Artificial Sequence
  source: /note="Description of Artificial Sequence: Synthetic polypeptide"
QIQLQESGPGLVKPSETLSLTCTVSGFSIN

SEQ ID NO: 6015 - protein, 14 aa, Artificial Sequence
  source: /note="Description of Artificial Sequence: Synthetic peptide"
WIRQPAGKGLEWIG

SEQ ID NO: 6016 - protein, 32 aa, Artificial Sequence
  source: /note="Description of Artificial Sequence: Synthetic polypeptide"
RVTMSRDTSKNQFSLKLSSVTAADTAVYYCAR

SEQ ID NO: 6017 - protein, 11 aa, Artificial Sequence
  source: /note="Description of Artificial Sequence: Synthetic peptide"
WGQGTMVTVSS

SEQ ID NO: 6018 - protein, 30 aa, Artificial Sequence
  source: /note="Description of Artificial Sequence: Synthetic polypeptide"
QIQLQESGPGLVKPSQTLSLTCTVSGFSIN

SEQ ID NO: 6019 - protein, 14 aa, Artificial Sequence
  source: /note="Description of Artificial Sequence: Synthetic peptide"
WIRQHPGKGLEWIG

SEQ ID NO: 6020 - protein, 32 aa, Artificial Sequence
  source: /note="Description of Artificial Sequence: Synthetic polypeptide"
LVTISRDTSKNQFSLKLSSVTAADTAVYYCAR

SEQ ID NO: 6021 - protein, 11 aa, Artificial Sequence
  source: /note="Description of Artificial Sequence: Synthetic peptide"
WGQGTMVTVSS

SEQ ID NO: 6022 - protein, 30 aa, Artificial Sequence
  source: /note="Description of Artificial Sequence: Synthetic polypeptide"
EIQLLESGGGLVQPGGSLRLSCAVSGFSIN

SEQ ID NO: 6023 - protein, 14 aa, Artificial Sequence
  source: /note="Description of Artificial Sequence: Synthetic peptide"
WVRQAPGKGLEWVG

SEQ ID NO: 6024 - protein, 32 aa, Artificial Sequence
  source: /note="Description of Artificial Sequence: Synthetic polypeptide"
RFTISRDTSKNTFYLQMNSLRAEDTAVYYCAR

SEQ ID NO: 6025 - protein, 11 aa, Artificial Sequence
  source: /note="Description of Artificial Sequence: Synthetic peptide"
WGQGTMVTVSS

SEQ ID NO: 6026 - protein, 30 aa, Artificial Sequence
  source: /note="Description of Artificial Sequence: Synthetic polypeptide"
QIQLVQSGAEVKKPGSSVKVSCKVSGFSIN

SEQ ID NO: 6027 - protein, 14 aa, Artificial Sequence
  source: /note="Description of Artificial Sequence: Synthetic peptide"
WVRQAPGQGLEWMG

SEQ ID NO: 6028 - protein, 32 aa, Artificial Sequence
  source: /note="Description of Artificial Sequence: Synthetic polypeptide"
RVTITRDTSTNTFYMELSSLRSEDTAVYYCAR

SEQ ID NO: 6029 - protein, 11 aa, Artificial Sequence
  source: /note="Description of Artificial Sequence: Synthetic peptide"
WGQGTMVTVSS

SEQ ID NO: 6030 - protein, 30 aa, Artificial Sequence
  source: /note="Description of Artificial Sequence: Synthetic polypeptide"
EIQLVESGGGLVQPGGSLRLSCAVSGFSIN

SEQ ID NO: 6031 - skipped

SEQ ID NO: 6032 - protein, 14 aa, Artificial Sequence
  source: /note="Description of Artificial Sequence: Synthetic peptide"
WVRQAPGKGLEWVG

SEQ ID NO: 6033 - protein, 32 aa, Artificial Sequence
  source: /note="Description of Artificial Sequence: Synthetic polypeptide"
RFTISRDTAKNSFYLQMNSLRAEDTAVYYCAR

SEQ ID NO: 6034 - protein, 11 aa, Artificial Sequence
  source: /note="Description of Artificial Sequence: Synthetic peptide"
WGQGTMVTVSS

SEQ ID NO: 6035 - protein, 30 aa, Artificial Sequence
  source: /note="Description of Artificial Sequence: Synthetic polypeptide"
QIQLVQSGAEVKKPGASVKVSCKVSGFSIN

SEQ ID NO: 6036 - protein, 14 aa, Artificial Sequence
  source: /note="Description of Artificial Sequence: Synthetic peptide"
WVRQAPGQGLEWMG

SEQ ID NO: 6037 - protein, 32 aa, Artificial Sequence
  source: /note="Description of Artificial Sequence: Synthetic polypeptide"
RVTMTRDTSTNTFYMELSSLRSEDTAVYYCAR

SEQ ID NO: 6038 - protein, 11 aa, Artificial Sequence
  source: /note="Description of Artificial Sequence: Synthetic peptide"
WGQGTMVTVSS

SEQ ID NO: 6039 - protein, 30 aa, Artificial Sequence; identical to SEQ ID NO: 6018
  source: /note="Description of Artificial Sequence: Synthetic polypeptide"

SEQ ID NO: 6040 - protein, 14 aa, Artificial Sequence
  source: /note="Description of Artificial Sequence: Synthetic peptide"
WIRQHPGKGLEWIG

SEQ ID NO: 6041 - protein, 32 aa, Artificial Sequence; identical to SEQ ID NO: 6020
  source: /note="Description of Artificial Sequence: Synthetic polypeptide"

SEQ ID NO: 6042 - protein, 11 aa, Artificial Sequence
  source: /note="Description of Artificial Sequence: Synthetic peptide"
WGQGTLVTVSS

SEQ ID NO: 6043 - protein, 30 aa, Artificial Sequence; identical to SEQ ID NO: 6014
  source: /note="Description of Artificial Sequence: Synthetic polypeptide"

SEQ ID NO: 6044 - protein, 14 aa, Artificial Sequence
  source: /note="Description of Artificial Sequence: Synthetic peptide"
WIRQPAGKGLEWIG

SEQ ID NO: 6045 - protein, 32 aa, Artificial Sequence; identical to SEQ ID NO: 6016
  source: /note="Description of Artificial Sequence: Synthetic polypeptide"

SEQ ID NO: 6046 - protein, 11 aa, Artificial Sequence
  source: /note="Description of Artificial Sequence: Synthetic peptide"
WGQGTLVTVSS

SEQ ID NO: 6047 - protein, 30 aa, Artificial Sequence; identical to SEQ ID NO: 6022
  source: /note="Description of Artificial Sequence: Synthetic polypeptide"

SEQ ID NO: 6048 - protein, 14 aa, Artificial Sequence
  source: /note="Description of Artificial Sequence: Synthetic peptide"
WVRQAPGKGLEWVG

SEQ ID NO: 6049 - protein, 32 aa, Artificial Sequence; identical to SEQ ID NO: 6024
  source: /note="Description of Artificial Sequence: Synthetic polypeptide"

SEQ ID NO: 6050 - protein, 11 aa, Artificial Sequence
  source: /note="Description of Artificial Sequence: Synthetic peptide"
WGQGTLVTVSS

SEQ ID NO: 6051 - protein, 30 aa, Artificial Sequence
  source: /note="Description of Artificial Sequence: Synthetic polypeptide"
QIQLVESGGGLVKPGGSLRLSCAVSGFSIN

SEQ ID NO: 6052 - protein, 14 aa, Artificial Sequence
  source: /note="Description of Artificial Sequence: Synthetic peptide"
WIRQAPGKGLEWVG

SEQ ID NO: 6053 - protein, 32 aa, Artificial Sequence; identical to SEQ ID NO: 6033
  source: /note="Description of Artificial Sequence: Synthetic polypeptide"

SEQ ID NO: 6054 - protein, 11 aa, Artificial Sequence
  source: /note="Description of Artificial Sequence: Synthetic peptide"
WGQGTLVTVSS

SEQ ID NO: 6055 - protein, 30 aa, Artificial Sequence; identical to SEQ ID NO: 6035
  source: /note="Description of Artificial Sequence: Synthetic polypeptide"

SEQ ID NO: 6056 - protein, 14 aa, Artificial Sequence
  source: /note="Description of Artificial Sequence: Synthetic peptide"
WVRQAPGQGLEWMG

SEQ ID NO: 6057 - protein, 32 aa, Artificial Sequence; identical to SEQ ID NO: 6037
  source: /note="Description of Artificial Sequence: Synthetic polypeptide"

SEQ ID NO: 6058 - protein, 11 aa, Artificial Sequence
  source: /note="Description of Artificial Sequence: Synthetic peptide"
WGQGTLVTVSS

SEQ ID NO: 6059 - protein, 30 aa, Artificial Sequence
  source: /note="Description of Artificial Sequence: Synthetic polypeptide"
EIQLVQSGAEVKKPGATVKISCKVSGFSIN

SEQ ID NO: 6060 - protein, 14 aa, Artificial Sequence
  source: /note="Description of Artificial Sequence: Synthetic peptide"
WVQQAPGKGLEWMG

SEQ ID NO: 6061 - protein, 32 aa, Artificial Sequence; identical to SEQ ID NO: 6028
  source: /note="Description of Artificial Sequence: Synthetic polypeptide"

SEQ ID NO: 6062 - protein, 11 aa, Artificial Sequence
  source: /note="Description of Artificial Sequence: Synthetic peptide"
WGQGTLVTVSS

SEQ ID NO: 6063 - protein, 11 aa, Artificial Sequence
  source: /note="Description of Artificial Sequence: Synthetic peptide"
SGERLSDKYVH

SEQ ID NO: 6064 - protein, 7 aa, Artificial Sequence
  source: /note="Description of Artificial Sequence: Synthetic peptide"
ENDKRPS

SEQ ID NO: 6065 - protein, 10 aa, Artificial Sequence
  source: /note="Description of Artificial Sequence: Synthetic peptide"
QAGYEADYYC

SEQ ID NO: 6066 - protein, 22 aa, Artificial Sequence
  source: /note="Description of Artificial Sequence: Synthetic peptide"
SYTLTQPPLLSVALGHKATITC

SEQ ID NO: 6067 - protein, 15 aa, Artificial Sequence
  source: /note="Description of Artificial Sequence: Synthetic peptide"
WYQQKPGRAPVMVIY

SEQ ID NO: 6068 - protein, 22 aa, Artificial Sequence
  source: /note="Description of Artificial Sequence: Synthetic peptide"
GIPDQFSGSNSGNIATLTISKA

SEQ ID NO: 6069 - protein, 10 aa, Artificial Sequence
  source: /note="Description of Artificial Sequence: Synthetic peptide"
FGSGTQLTVL

SEQ ID NO: 6070 - protein, 11 aa, Artificial Sequence
  source: /note="Description of Artificial Sequence: Synthetic peptide"
SGENLSDKYVH

SEQ ID NO: 6071 - protein, 7 aa, Artificial Sequence
  source: /note="Description of Artificial Sequence: Synthetic peptide"
ENEKRPS

SEQ ID NO: 6072 - protein, 10 aa, Artificial Sequence
  source: /note="Description of Artificial Sequence: Synthetic peptide"
HYWESINSVV

SEQ ID NO: 6073 - protein, 22 aa, Artificial Sequence
  source: /note="Description of Artificial Sequence: Synthetic peptide"
SYTLTQPPSLSVAPGQKATIIC

SEQ ID NO: 6074 - protein, 15 aa, Artificial Sequence
  source: /note="Description of Artificial Sequence: Synthetic peptide"
WYQQKPGRAPVMVIY

SEQ ID NO: 6075 - protein, 32 aa, Artificial Sequence
  source: /note="Description of Artificial Sequence: Synthetic polypeptide"
GIPDQFSGSNSGNIATLTISKAQPGSEADYYC

SEQ ID NO: 6076 - protein, 10 aa, Artificial Sequence
  source: /note="Description of Artificial Sequence: Synthetic peptide"
FGSGTHLTVL

SEQ ID NO: 6077 - protein, 22 aa, Artificial Sequence
  source: /note="Description of Artificial Sequence: Synthetic peptide"
QSVTTQPPSVSGAPGQRVTISC

SEQ ID NO: 6078 - protein, 15 aa, Artificial Sequence
  source: /note="Description of Artificial Sequence: Synthetic peptide"
WYQQLPGTAPKMLIY

SEQ ID NO: 6079 - protein, 32 aa, Artificial Sequence
  source: /note="Description of Artificial Sequence: Synthetic polypeptide"
GVPDRFSGSNSGNSASLAITGLQAEDEADYYC

SEQ ID NO: 6080 - protein, 10 aa, Artificial Sequence
  source: /note="Description of Artificial Sequence: Synthetic peptide"
FGGGTQLTVL

SEQ ID NO: 6081 - protein, 22 aa, Artificial Sequence
  source: /note="Description of Artificial Sequence: Synthetic peptide"
QSVTTQPPSASGTPGQRVTISC

SEQ ID NO: 6082 - protein, 15 aa, Artificial Sequence
  source: /note="Description of Artificial Sequence: Synthetic peptide"
WYQQLPGTAPKMLIY

SEQ ID NO: 6083 - protein, 32 aa, Artificial Sequence
  source: /note="Description of Artificial Sequence: Synthetic polypeptide"
GVPDRFSGSNSGNSASLAISGLQSEDEADYYC

SEQ ID NO: 6084 - protein, 10 aa, Artificial Sequence
  source: /note="Description of Artificial Sequence: Synthetic peptide"
FGGGTQLTVL

SEQ ID NO: 6085 - protein, 22 aa, Artificial Sequence
  source: /note="Description of Artificial Sequence: Synthetic peptide"
QSVTTQPPSASGTPGQRVTISC

SEQ ID NO: 6086 - protein, 15 aa, Artificial Sequence
  source: /note="Description of Artificial Sequence: Synthetic peptide"
WYQQLPGTAPKMLIY

SEQ ID NO: 6087 - protein, 32 aa, Artificial Sequence
  source: /note="Description of Artificial Sequence: Synthetic polypeptide"
GVPDRFSGSNSGNSASLAISGLRSEDEADYYC

SEQ ID NO: 6088 - protein, 10 aa, Artificial Sequence
  source: /note="Description of Artificial Sequence: Synthetic peptide"
FGGGTQLTVL

SEQ ID NO: 6089 - protein, 22 aa, Artificial Sequence
  source: /note="Description of Artificial Sequence: Synthetic peptide"
SSETTQPHSVSVATAQMARITC

SEQ ID NO: 6090 - protein, 15 aa, Artificial Sequence
  source: /note="Description of Artificial Sequence: Synthetic peptide"
WYQQKPGQDPVMVIY

SEQ ID NO: 6091 - protein, 32 aa, Artificial Sequence
  source: /note="Description of Artificial Sequence: Synthetic polypeptide"
GIPERFSGSNPGNTATLTISRIEAGDEADYYC

SEQ ID NO: 6092 - protein, 10 aa, Artificial Sequence
  source: /note="Description of Artificial Sequence: Synthetic peptide"
FGGGTQLTVL

SEQ ID NO: 6093 - protein, 23 aa, Artificial Sequence
  source: /note="Description of Artificial Sequence: Synthetic peptide"
DIQMTQSPSTLSASVGDRVTITC

SEQ ID NO: 6094 - protein, 15 aa, Artificial Sequence
  source: /note="Description of Artificial Sequence: Synthetic peptide"
WYQQKPGKAPKMLIY

SEQ ID NO: 6095 - protein, 32 aa, Artificial Sequence
  source: /note="Description of Artificial Sequence: Synthetic polypeptide"
GVPSRFSGSNSGNEATLTISSLQPDDFATYYC

SEQ ID NO: 6096 - protein, 10 aa, Artificial Sequence
  source: /note="Description of Artificial Sequence: Synthetic peptide"
FGQGTKVEIK

SEQ ID NO: 6097 - protein, 22 aa, Artificial Sequence
  source: /note="Description of Artificial Sequence: Synthetic peptide"
QYVLTQPPSASGTPGQRVTISC

SEQ ID NO: 6098 - protein, 15 aa, Artificial Sequence
  source: /note="Description of Artificial Sequence: Synthetic peptide"
WYQQLPGTAPKMLIY

SEQ ID NO: 6099 - protein, 32 aa, Artificial Sequence; identical to SEQ ID NO: 6083
  source: /note="Description of Artificial Sequence: Synthetic polypeptide"

SEQ ID NO: 6100 - protein, 10 aa, Artificial Sequence
  source: /note="Description of Artificial Sequence: Synthetic peptide"
FGEGTELTVL

SEQ ID NO: 6101 - protein, 22 aa, Artificial Sequence
  source: /note="Description of Artificial Sequence: Synthetic peptide"
QYVLTQPPSASGTPGQRVTISC

SEQ ID NO: 6102 - protein, 15 aa, Artificial Sequence
  source: /note="Description of Artificial Sequence: Synthetic peptide"
WYQQLPGTAPKMLIY

SEQ ID NO: 6103 - protein, 32 aa, Artificial Sequence; identical to SEQ ID NO: 6087
  source: /note="Description of Artificial Sequence: Synthetic polypeptide"

SEQ ID NO: 6104 - protein, 10 aa, Artificial Sequence
  source: /note="Description of Artificial Sequence: Synthetic peptide"
FGEGTELTVL

SEQ ID NO: 6105 - protein, 22 aa, Artificial Sequence
  source: /note="Description of Artificial Sequence: Synthetic peptide"
SYELTQPPSVSVSPGQTASITC

SEQ ID NO: 6106 - protein, 15 aa, Artificial Sequence
  source: /note="Description of Artificial Sequence: Synthetic peptide"
WYQQKPGQSPVMVIY

SEQ ID NO: 6107 - protein, 32 aa, Artificial Sequence
  source: /note="Description of Artificial Sequence: Synthetic polypeptide"
GIPERFSGSNSGNTATLTISGTQAMDEADYYC

SEQ ID NO: 6108 - protein, 10 aa, Artificial Sequence
  source: /note="Description of Artificial Sequence: Synthetic peptide"
FGEGTELTVL

SEQ ID NO: 6109 - protein, 23 aa, Artificial Sequence
  source: /note="Description of Artificial Sequence: Synthetic peptide"
DYVLTQSPLSLPVTPGEPASISC

SEQ ID NO: 6110 - protein, 15 aa, Artificial Sequence
  source: /note="Description of Artificial Sequence: Synthetic peptide"
WYLQKPGQSPQMLIY

SEQ ID NO: 6111 - protein, 32 aa, Artificial Sequence
  source: /note="Description of Artificial Sequence: Synthetic polypeptide"
GVPDRFSGSNSGNDATLKISRVEAEDVGVYYC

SEQ ID NO: 6112 - protein, 10 aa, Artificial Sequence
  source: /note="Description of Artificial Sequence: Synthetic peptide"
FGQGTKVEIK

SEQ ID NO: 6113 - protein, 23 aa, Artificial Sequence
  source: /note="Description of Artificial Sequence: Synthetic peptide"
AYQLTQSPSSLSASVGDRVTITC

SEQ ID NO: 6114 - protein, 15 aa, Artificial Sequence
  source: /note="Description of Artificial Sequence: Synthetic peptide"
WYQQKPGKAPKMLIY

SEQ ID NO: 6115 - protein, 32 aa, Artificial Sequence
  source: /note="Description of Artificial Sequence: Synthetic polypeptide"
GVPSRFSGSNSGNDATLTISSLQPEDFATYYC

SEQ ID NO: 6116 - protein, 10 aa, Artificial Sequence
  source: /note="Description of Artificial Sequence: Synthetic peptide"
FGQGTKVEIK

SEQ ID NO: 6117 - protein, 23 aa, Artificial Sequence
  source: /note="Description of Artificial Sequence: Synthetic peptide"
EYVLTQSPATLSVSPGERATLSC

SEQ ID NO: 6118 - protein, 15 aa, Artificial Sequence
  source: /note="Description of Artificial Sequence: Synthetic peptide"
WYQQKPGQAPRMLIY

SEQ ID NO: 6119 - protein, 32 aa, Artificial Sequence
  source: /note="Description of Artificial Sequence: Synthetic polypeptide"
GIPARFSGSNSGNEATLTISSLQSEDFAVYYC

SEQ ID NO: 6120 - protein, 10 aa, Artificial Sequence
  source: /note="Description of Artificial Sequence: Synthetic peptide"
FGQGTKVEIK

SEQ ID NO: 6121 - protein, 118 aa, Artificial Sequence
  source: /note="Description of Artificial Sequence: Synthetic polypeptide"
QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSS

SEQ ID NO: 6122 - protein, 118 aa, Artificial Sequence
  source: /note="Description of Artificial Sequence: Synthetic polypeptide"
QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSS

SEQ ID NO: 6123 - protein, 118 aa, Artificial Sequence
  source: /note="Description of Artificial Sequence: Synthetic polypeptide"
QIQLQESGPGLVKPSETLSLTCTVSGFSINTGGYHWNWIRQPAGKGLEWIGYIYSSGSTSYNPSLKSRVTMSRDTSKNQFSLKLSSVTAADTAVYYCARGNWHYFDFWGQGTMVTVSS

SEQ ID NO: 6124 - protein, 118 aa, Artificial Sequence
  source: /note="Description of Artificial Sequence: Synthetic polypeptide"
QIQLQESGPGLVKPSQTLSLTCTVSGFSINTGGYHWNWIRQHPGKGLEWIGYIYSSGSTSYNPSLKSLVTISRDTSKNQFSLKLSSVTAADTAVYYCARGNWHYFDFWGQGTMVTVSS

SEQ ID NO: 6125 - protein, 118 aa, Artificial Sequence
  source: /note="Description of Artificial Sequence: Synthetic polypeptide"
EIQLLESGGGLVQPGGSLRLSCAVSGFSINTGGYHWNWVRQAPGKGLEWVGYIYSSGSTSYNPSLKSRFTISRDTSKNTFYLQMNSLRAEDTAVYYCARGNWHYFDFWGQGTMVTVSS

SEQ ID NO: 6126 - protein, 118 aa, Artificial Sequence
  source: /note="Description of Artificial Sequence: Synthetic polypeptide"
QIQLVQSGAEVKKPGSSVKVSCKVSGFSINTGGYHWNWVRQAPGQGLEWMGYIYSSGSTSYNPSLKSRVTITRDTSTNTFYMELSSLRSEDTAVYYCARGNWHYFDFWGQGTMVTVSS

SEQ ID NO: 6127 - protein, 118 aa, Artificial Sequence
  source: /note="Description of Artificial Sequence: Synthetic polypeptide"
EIQLVESGGGLVQPGGSLRLSCAVSGFSINTGGYHWNWVRQAPGKGLEWVGYIYSSGSTSYNPSLKSRFTISRDTAKNSFYLQMNSLRAEDTAVYYCARGNWHYFDFWGQGTMVTVSS

SEQ ID NO: 6128 - protein, 118 aa, Artificial Sequence
  source: /note="Description of Artificial Sequence: Synthetic polypeptide"
QIQLVQSGAEVKKPGASVKVSCKVSGFSINTGGYHWNWVRQAPGQGLEWMGYIYSSGSTSYNPSLKSRVTMTRDTSTNTFYMELSSLRSEDTAVYYCARGNWHYFDFWGQGTMVTVSS

SEQ ID NO: 6129 - protein, 118 aa, Artificial Sequence
  source: /note="Description of Artificial Sequence: Synthetic polypeptide"
QIQLQESGPGLVKPSQTLSLTCTVSGFSINTGGYHWNWIRQHPGKGLEWIGYIYSSGTTRYNPSLKSLVTISRDTSKNQFSLKLSSVTAADTAVYYCARGNWHYFDYWGQGTLVTVSS

SEQ ID NO: 6130 - protein, 118 aa, Artificial Sequence
  source: /note="Description of Artificial Sequence: Synthetic polypeptide"
QIQLQESGPGLVKPSETLSLTCTVSGFSINTGGYHWNWIRQPAGKGLEWIGYIYSSGTTRYNPSLKSRVTMSRDTSKNQFSLKLSSVTAADTAVYYCARGNWHYFDYWGQGTLVTVSS

SEQ ID NO: 6131 - protein, 118 aa, Artificial Sequence
  source: /note="Description of Artificial Sequence: Synthetic polypeptide"
EIQLLESGGGLVQPGGSLRLSCAVSGFSINTGGYHWNWVRQAPGKGLEWVGYIYSSGTTRYNPSLKSRFTISRDTSKNTFYLQMNSLRAEDTAVYYCARGNWHYFDYWGQGTLVTVSS

SEQ ID NO: 6132 - protein, 118 aa, Artificial Sequence
  source: /note="Description of Artificial Sequence: Synthetic polypeptide"
QIQLVESGGGLVKPGGSLRLSCAVSGFSINTGGYHWNWIRQAPGKGLEWVGYIYSSGTTRYNPSLKSRFTISRDTAKNSFYLQMNSLRAEDTAVYYCARGNWHYFDYWGQGTLVTVSS

SEQ ID NO: 6133 - protein, 118 aa, Artificial Sequence
  source: /note="Description of Artificial Sequence: Synthetic polypeptide"
QIQLVQSGAEVKKPGASVKVSCKVSGFSINTGGYHWNWVRQAPGQGLEWMGYIYSSGTTRYNPSLKSRVTMTRDTSTNTFYMELSSLRSEDTAVYYCARGNWHYFDYWGQGTLVTVSS

SEQ ID NO: 6134 - protein, 118 aa, Artificial Sequence
  source: /note="Description of Artificial Sequence: Synthetic polypeptide"
EIQLVQSGAEVKKPGATVKISCKVSGFSINTGGYHWNWVQQAPGKGLEWMGYIYSSGTTRYNPSLKSRVTITRDTSTNTFYMELSSLRSEDTAVYYCARGNWHYFDYWGQGTLVTVSS

SEQ ID NO: 6135 - protein, 97 aa, Artificial Sequence
  source: /note="Description of Artificial Sequence: Synthetic polypeptide"
SYTLTQPPLLSVALGHKATITCSGERLSDKYVHWYQQKPGRAPVMVIYENDKRPSGIPDQFSGSNSGNIATLTISKAQAGYEADYYCFGSGTQLTVL

SEQ ID NO: 6136 - protein, 107 aa, Artificial Sequence
  source: /note="Description of Artificial Sequence: Synthetic polypeptide"
SYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVL

SEQ ID NO: 6137 - protein, 107 aa, Artificial Sequence
  source: /note="Description of Artificial Sequence: Synthetic polypeptide"
QSVTTQPPSVSGAPGQRVTISCSGERLSDKYVHWYQQLPGTAPKMLIYENDKRPSGVPDRFSGSNSGNSASLAITGLQAEDEADYYCQSWDSTNSAVFGGGTQLTVL

SEQ ID NO: 6138 - protein, 107 aa, Artificial Sequence
  source: /note="Description of Artificial Sequence: Synthetic polypeptide"
QSVTTQPPSASGTPGQRVTISCSGERLSDKYVHWYQQLPGTAPKMLIYENDKRPSGVPDRFSGSNSGNSASLAISGLQSEDEADYYCQSWDSTNSAVFGGGTQLTVL

SEQ ID NO: 6139 - protein, 107 aa, Artificial Sequence
  source: /note="Description of Artificial Sequence: Synthetic polypeptide"
QSVTTQPPSASGTPGQRVTISCSGERLSDKYVHWYQQLPGTAPKMLIYENDKRPSGVPDRFSGSNSGNSASLAISGLRSEDEADYYCQSWDSTNSAVFGGGTQLTVL

SEQ ID NO: 6140 - protein, 107 aa, Artificial Sequence
  source: /note="Description of Artificial Sequence: Synthetic polypeptide"
SSETTQPHSVSVATAQMARITCSGERLSDKYVHWYQQKPGQDPVMVIYENDKRPSGIPERFSGSNPGNTATLTISRIEAGDEADYYCQSWDSTNSAVFGGGTQLTVL

SEQ ID NO: 6141 - protein, 108 aa, Artificial Sequence
  source: /note="Description of Artificial Sequence: Synthetic polypeptide"
DIQMTQSPSTLSASVGDRVTITCSGERLSDKYVHWYQQKPGKAPKMLIYENDKRPSGVPSRFSGSNSGNEATLTISSLQPDDFATYYCQSWDSTNSAVFGQGTKVEIK

SEQ ID NO: 6142 - protein, 107 aa, Artificial Sequence
  source: /note="Description of Artificial Sequence: Synthetic polypeptide"
QYVLTQPPSASGTPGQRVTISCSGENLSDKYVHWYQQLPGTAPKMLIYENEKRPSGVPDRFSGSNSGNSASLAISGLQSEDEADYYCHYWESINSVVFGEGTELTVL

SEQ ID NO: 6143 - protein, 107 aa, Artificial Sequence
  source: /note="Description of Artificial Sequence: Synthetic polypeptide"
QYVLTQPPSASGTPGQRVTISCSGENLSDKYVHWYQQLPGTAPKMLIYENEKRPSGVPDRFSGSNSGNSASLAISGLRSEDEADYYCHYWESINSVVFGEGTELTVL

SEQ ID NO: 6144 - protein, 107 aa, Artificial Sequence
  source: /note="Description of Artificial Sequence: Synthetic polypeptide"
SYELTQPPSVSVSPGQTASITCSGENLSDKYVHWYQQKPGQSPVMVIYENEKRPSGIPERFSGSNSGNTATLTISGTQAMDEADYYCHYWESINSVVFGEGTELTVL

SEQ ID NO: 6145 - protein, 108 aa, Artificial Sequence
  source: /note="Description of Artificial Sequence: Synthetic polypeptide"
DYVLTQSPLSLPVTPGEPASISCSGENLSDKYVHWYLQKPGQSPQMLIYENEKRPSGVPDRFSGSNSGNDATLKISRVEAEDVGVYYCHYWESINSVVFGQGTKVEIK

SEQ ID NO: 6146 - protein, 108 aa, Artificial Sequence
  source: /note="Description of Artificial Sequence: Synthetic polypeptide"
AYQLTQSPSSLSASVGDRVTITCSGENLSDKYVHWYQQKPGKAPKMLIYENEKRPSGVPSRFSGSNSGNDATLTISSLQPEDFATYYCHYWESINSVVFGQGTKVEIK

SEQ ID NO: 6147 - protein, 108 aa, Artificial Sequence
  source: /note="Description of Artificial Sequence: Synthetic polypeptide"
EYVLTQSPATLSVSPGERATLSCSGENLSDKYVHWYQQKPGQAPRMLIYENEKRPSGIPARFSGSNSGNEATLTISSLQSEDFAVYYCHYWESINSVVFGQGTKVEIK

SEQ ID NO: 6148 - protein, 448 aa, Artificial Sequence
  source: /note="Description of Artificial Sequence: Synthetic polypeptide"
QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 6149 - protein, 448 aa, Artificial Sequence
  source: /note="Description of Artificial Sequence: Synthetic polypeptide"
QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 6150 - protein, 213 aa, Artificial Sequence
  source: /note="Description of Artificial Sequence: Synthetic polypeptide"
SYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 6151 - protein, 448 aa, Artificial Sequence
  source: /note="Description of Artificial Sequence: Synthetic polypeptide"
QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 6152 - protein, 448 aa, Artificial Sequence
  source: /note="Description of Artificial Sequence: Synthetic polypeptide"
QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 6153 - protein, 213 aa, Artificial Sequence
  source: /note="Description of Artificial Sequence: Synthetic polypeptide"
SYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 6154 - protein, 454 aa, Artificial Sequence
  source: /note="Description of Artificial Sequence: Synthetic polypeptide"
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6155 - protein, 454 aa, Artificial Sequence
  source: /note="Description of Artificial Sequence: Synthetic polypeptide"
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6156 - protein, 219 aa, Artificial Sequence
  source: /note="Description of Artificial Sequence: Synthetic polypeptide"
DVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6157 - protein, 440 aa, Artificial Sequence
  source: /note="Description of Artificial Sequence: Synthetic polypeptide"
METDTLLLWVLLLWVPGSTGDYKDDDDKGGGGSGTGGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGSGNGTSNGTSGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6158 - protein, 601 aa, Artificial Sequence
  source: /note="Description of Artificial Sequence: Synthetic polypeptide"
METDTLLLWVLLLWVPGSTGDYKDDDDKGGGGSGTGGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGSGNGTSNGTSGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6159 - protein, 762 aa, Artificial Sequence
  source: /note="Description of Artificial Sequence: Synthetic polypeptide"
METDTLLLWVLLLWVPGSTGDYKDDDDKGGGGSGTGGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGAAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFAVSGSGNGTSNGTSGSSGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6160 - protein, 444 aa, Artificial Sequence
  source: /note="Description of Artificial Sequence: Synthetic polypeptide"
METDTLLLWVLLLWVPGSTGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6161 - protein, 642 aa, Artificial Sequence
  source: /note="Description of Artificial Sequence: Synthetic polypeptide"
METDTLLLWVLLLWVPGSTGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6162 - protein, 840 aa, Artificial Sequence
  source: /note="Description of Artificial Sequence: Synthetic polypeptide"
METDTLLLWVLLLWVPGSTGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSGTSEETISTVQEKQQNISPLVRERGPQRVAAHITGTRGRSNTLSSPNSKNEKALGRKINSWESSRSGHSFLSNLHLRNGELVIHEKGFYYIYSQTYFRFQEEIKENTKNDKQMVQYIYKYTSYPDPILLMKSARNSCWSKDAEYGLYSIYQGGIFELKENDRIFVSVTNEHLIDMDHEASFFGAFLVGGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6163 - protein, 502 aa, Artificial Sequence
  source: /note="Description of Artificial Sequence: Synthetic polypeptide"
METDTLLLWVLLLWVPGSTGEVQLVESGGGLVQPGGSLRLSCAASGFTFSSYVMSWVRQAPGKGLEWVATISSGGSYTYYPDSVKGRFTISRDNAKNTLYLQMNSLRAEDTAVYYCARRGDSMITTDYWGQGTLVTVSSGGGGSGGGGSGGGGSGGGGSDIQMTQSPSSLSASVGDRVTITCKASQDVGTAVAWYQQKPGKAPKLLIYWASTRHTGVPSRFSGSGSGTDFTLTISSLQPEDFATYYCQQYSSYRTFGQGTKVEIKGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6164 - protein, 505 aa, Artificial Sequence
  source: /note="Description of Artificial Sequence: Synthetic polypeptide"
METDTLLLWVLLLWVPGSTGEVQLVQSGGGVERPGGSLRLSCAASGFTFDDYAMSWVRQAPGKGLEWVSGINWQGGSTGYADSVKGRVTISRDNAKNSLYLQMNSLRAEDTAVYYCAKILGAGRGWYFDYWGKGTTVTVSSGGGGSGGGGSGGGGSGGGGSSELTQDPAVSVALGQTVRITCSGDSLRSYYASWYQQKPGQAPVLVIYGANNRPSGIPDRFSGSSSGNTASLTITGAQAEDEADYYCNSADSSGNHVVFGGGTKLTVLGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6165 - protein, 508 aa, Artificial Sequence
  source: /note="Description of Artificial Sequence: Synthetic polypeptide"
METDTLLLWVLLLWVPGSTGQVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYYYGMDVWGQGTTVTVSSGGGGSGGGGSGGGGSGGGGSEIVLTQSPGTLSLSPGERATLSCRASQGISRSYLAWYQQKPGQAPSLLIYGASSRATGIPDRFSGSGSGTDFTLTISRLEPEDFAVYYCQQFGSSPWTFGQGTKVEIKRGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6166 - skipped

SEQ ID NO: 6167 - protein, 474 aa, Artificial Sequence
  source: /note="Description of Artificial Sequence: Synthetic polypeptide"
METDTLLLWVLLLWVPGSTGQVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 6168 - protein, 474 aa, Artificial Sequence
  source: /note="Description of Artificial Sequence: Synthetic polypeptide"
METDTLLLWVLLLWVPGSTGQVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6169 - protein, 239 aa, Artificial Sequence
  source: /note="Description of Artificial Sequence: Synthetic polypeptide"
METDTLLLWVLLLWVPGSTGDVVMTQSPLSLPVTLGQPASISCRSSQRLVHSNGNTYLHWYQQRPGQSPRLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6170 - protein, 499 aa, Artificial Sequence
  source: /note="Description of Artificial Sequence: Synthetic polypeptide"
METDTLLLWVLLLWVPGSTGDVVMTQSPLSLPVTPGEPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSEVQLVESGGGLVQPGGSLRLSCAASGFTFSSYVMSWVRQAPGKGLEWVATISSGGSYTYYPDSVKGRFTISRDNAKNTLYLQMNSLRAEDTAVYYCARRGDSMITTDYWGQGTLVTVSSGGGGSGGGGSGGGGSGGGGSDIQMTQSPSSLSASVGDRVTITCKASQDVGTAVAWYQQKPGKAPKLLIYWASTRHTGVPSRFSGSGSGTDFTLTISSLQPEDFATYYCQQYSSYRTFGQGTKVEIK

SEQ ID NO: 6171 - protein, 505 aa, Artificial Sequence
  source: /note="Description of Artificial Sequence: Synthetic polypeptide"
METDTLLLWVLLLWVPGSTGDVVMTQSPLSLPVTPGEPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSQVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYYYGMDVWGQGTTVTVSSGGGGSGGGGSGGGGSGGGGSEIVLTQSPGTLSLSPGERATLSCRASQGISRSYLAWYQQKPGQAPSLLIYGASSRATGIPDRFSGSGSGTDFTLTISRLEPEDFAVYYCQQFGSSPWTFGQGTKVEIKR

SEQ ID NO: 6172 - protein, 502 aa, Artificial Sequence
  source: /note="Description of Artificial Sequence: Synthetic polypeptide"
METDTLLLWVLLLWVPGSTGDVVMTQSPLSLPVTPGEPASISCRSSQRLVHSNGNTYLHWYLQKPGQSPQLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSEVQLVQSGGGVERPGGSLRLSCAASGFTFDDYAMSWVRQAPGKGLEWVSGINWQGGSTGYADSVKGRVTISRDNAKNSLYLQMNSLRAEDTAVYYCAKILGAGRGWYFDYWGKGTTVTVSSGGGGSGGGGSGGGGSGGGGSSELTQDPAVSVALGQTVRITCSGDSLRSYYASWYQQKPGQAPVLVIYGANNRPSGIPDRFSGSSSGNTASLTITGAQAEDEADYYCNSADSSGNHVVFGGGTKLTVL

SEQ ID NO: 6173 - protein, 597 aa, Artificial Sequence
  source: /note="Description of Artificial Sequence: Synthetic polypeptide"
METDTLLLWVLLLWVPGSTGQVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 6174 - protein, 159 aa, Artificial Sequence
  source: /note="Description of Artificial Sequence: Synthetic polypeptide"
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 6175 - protein, 243 aa, Artificial Sequence
  source: /note="Description of Artificial Sequence: Synthetic polypeptide"
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSGGGGSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 6176 - protein, 115 aa, Artificial Sequence
  source: /note="Description of Artificial Sequence: Synthetic polypeptide"
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSS

SEQ ID NO: 6177 - protein, 108 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 6178 - protein, 250 aa, Artificial Sequence
  source: /note="Description of Artificial Sequence: Synthetic polypeptide"
EVQLVQSGAEVKEPGESLKISCKNSGYSFTNYWVGWVRQMPGKGLEWMGIIYPGDSDTRYSPSFQGQVTISADKSINTAYLQWSSLKASDTAMYYCGRLTMFRGIIIGYFDYWGQGTLVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIK

SEQ ID NO: 6179 - protein, 123 aa, Artificial Sequence
  source: /note="Description of Artificial Sequence: Synthetic polypeptide"
EVQLVQSGAEVKEPGESLKISCKNSGYSFTNYWVGWVRQMPGKGLEWMGIIYPGDSDTRYSPSFQGQVTISADKSINTAYLQWSSLKASDTAMYYCGRLTMFRGIIIGYFDYWGQGTLVTVSS

SEQ ID NO: 6180 - protein, 107 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIK

SEQ ID NO: 6181 - protein, 247 aa, Artificial Sequence
  source: /note="Description of Artificial Sequence: Synthetic polypeptide"
QVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIK

SEQ ID NO: 6182 - protein, 120 aa, Artificial Sequence
  source: /note="Description of Artificial Sequence: Synthetic polypeptide"
QVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSS

SEQ ID NO: 6183 - protein, 107 aa, Artificial Sequence
  source: /note="Description of Artificial Sequence: Synthetic polypeptide"
DIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIK

SEQ ID NO: 6184 - protein, 239 aa, Artificial Sequence
  source: /note="Description of Artificial Sequence: Synthetic polypeptide"
EVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSRGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 6185 - protein, 117 aa, Artificial Sequence
  source: /note="Description of Artificial Sequence: Synthetic polypeptide"
EVQLVESGGGVVRPGGSLRLSCAASGFTFDDYGMSWVRQAPGKGLEWVSGINWNGGSTGYADSVKGRFTISRDNAKNSLYLQMNSLRAEDTAVYYCARGRSLLFDYWGQGTLVTVSR

SEQ ID NO: 6186 - protein, 108 aa, Artificial Sequence
  source: /note="Description of Artificial Sequence: Synthetic polypeptide"
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 6187 - protein, 245 aa, Artificial Sequence
  source: /note="Description of Artificial Sequence: Synthetic polypeptide"
QIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSSGGGGSGGGGSGGGGSGGGGSSYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVL

SEQ ID NO: 6188 - protein, 245 aa, Artificial Sequence
  source: /note="Description of Artificial Sequence: Synthetic polypeptide"
SYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVLGGGGSGGGGSGGGGSGGGGSQIQLQESGPGLVKPSQSLSLTCSVTGFSINTGGYHWNWIRQFPGKKLEWMGYIYSSGSTSYNPSLKSRISITRDTSKNQFFLQLNSVTTEDTATYYCARGNWHYFDFWGQGTMVTVSS

SEQ ID NO: 6189 - protein, 245 aa, Artificial Sequence
  source: /note="Description of Artificial Sequence: Synthetic polypeptide"
QIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSSGGGGSGGGGSGGGGSGGGGSSYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVL

SEQ ID NO: 6190 - protein, 245 aa, Artificial Sequence
  source: /note="Description of Artificial Sequence: Synthetic polypeptide"
SYTLTQPPSLSVAPGQKATIICSGENLSDKYVHWYQQKPGRAPVMVIYENEKRPSGIPDQFSGSNSGNIATLTISKAQPGSEADYYCHYWESINSVVFGSGTHLTVLGGGGSGGGGSGGGGSGGGGSQIQLQESGPGLVKPSQSLSLTCSVTGFSINTGGYHWNWIRQFPGKKLEWMGYIYSSGTTRYNPSLKSRISITRDTSKNQFFLQLNSVTPEDTATYYCTRGNWHYFDYWGQGTLVAVSS

SEQ ID NO: 6191 - protein, 227 aa, Artificial Sequence
  source: /note="Description of Artificial Sequence: Synthetic polypeptide"
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 6192-7016 - skipped (825 entries)

SEQ ID NO: 7017 - protein, 114 aa, Artificial Sequence
  source: /note="Description of Artificial Sequence: Synthetic polypeptide"
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 7018 - protein, 77 aa, Artificial Sequence
  source: /note="Description of Artificial Sequence: Synthetic polypeptide"
MAPRRARGCRTLGLPALLLLLLLRPPATRGITCPPPMSVEHADIWVKSYSLYSRERYICNSGFKRKAGTSSLTECVL

SEQ ID NO: 7019 - protein, 20 aa, Artificial Sequence
  source: /note="Description of Artificial Sequence: Synthetic peptide"
SGGSGGGGSGGGSGGGGSLQ

SEQ ID NO: 7020 - protein, 133 aa, Artificial Sequence [sequence omitted]

SEQ ID NO: 7021 - protein, 157 aa, Artificial Sequence
  source: /note="Description of Artificial Sequence: Synthetic polypeptide"
YFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 7022 - protein, 133 aa, Artificial Sequence [sequence omitted]

SEQ ID NO: 7023 - protein, 138 aa, Artificial Sequence
  source: /note="Description of Artificial Sequence: Synthetic polypeptide"
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRG

SEQ ID NO: 7024-7226 - skipped (203 entries)

SEQ ID NO: 7227 - protein, 133 aa, Artificial Sequence
  source: /note="Description of Artificial Sequence: Synthetic polypeptide"
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFAQSIISTLT

SEQ ID NO: 7228 - protein, 133 aa, Artificial Sequence
  source: /note="Description of Artificial Sequence: Synthetic polypeptide"
APASSSTKKTQLQLEHLLLDLQMILNGINNYKNPKLTRMLTAKFAMPKKATELKHLQCLEEELKPLEEVLNGAQSKNFHLRPRDLISNINVIVLELKGSETTFMCEYADETATIVEFLNRWITFAQSIISTLT

SEQ ID NO: 7229 - protein, 518 aa, Artificial Sequence
  source: /note="Description of Artificial Sequence: Synthetic polypeptide"
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 7230 - protein, 340 aa, Artificial Sequence
  source: /note="Description of Artificial Sequence: Synthetic polypeptide"
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRNGGGGSGGGGSGGGGSGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 7231 - protein, 166 aa, Artificial Sequence
  source: /note="Description of Artificial Sequence: Synthetic polypeptide"
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 7232 - protein, 114 aa, Artificial Sequence
  source: /note="Description of Artificial Sequence: Synthetic polypeptide"
NWVNVISDLKKIEDLIQSMHIDATLYTESDVHPSCKVTAMKCFLLELQVISLASGDASIHDTVENLIILANNSLSSNGAVTESGCKECEELEEKNIKEFLQSFVHIVQMFINTS

SEQ ID NO: 7233 - protein, 238 aa, Artificial Sequence
  source: /note="Description of Artificial Sequence: Synthetic polypeptide"
DLKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFS

SEQ ID NO: 7234 - protein, 284 aa, Artificial Sequence
  source: /note="Description of Artificial Sequence: Synthetic polypeptide"
EPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHW

SEQ ID NO: 7235 - protein, 287 aa, Artificial Sequence
  source: /note="Description of Artificial Sequence: Synthetic polypeptide"
AEPHSLRYNLMVLSQDESVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKVLVLQSQRTD

SEQ ID NO: 7236 - protein, 191 aa, Artificial Sequence
  source: /note="Description of Artificial Sequence: Synthetic polypeptide"
GWVDTHCLCYDFIITPKSRPEPQWCEVQGLVDERPFLHYDCVNHKAKAFASLGKKVNVTKTWEEQTETLRDVVDFLKGQLLDIQVENLIPIEPLTLQARMSCEHEAHGHGRGSWQFLFNGQKFLLFDSNNRKWTALHPGAKKMTEKWEKNRDVTMFFQKISLGDCKMWLEEFLMYWEQMLDPTKPPSLAPG

SEQ ID NO: 7237 - protein, 329 aa, Artificial Sequence
  source: /note="Description of Artificial Sequence: Synthetic polypeptide"
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 7238 - protein, 323 aa, Artificial Sequence
  source: /note="Description of Artificial Sequence: Synthetic polypeptide"
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 7239 - protein, 330 aa, Artificial Sequence
  source: /note="Description of Artificial Sequence: Synthetic polypeptide"
QNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDH

SEQ ID NO: 7240 - protein, 155 aa, Artificial Sequence
  source: /note="Description of Artificial Sequence: Synthetic polypeptide"
QRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 7241 - protein, 294 aa, Artificial Sequence
  source: /note="Description of Artificial Sequence: Synthetic polypeptide"
WTYHYSEKPMNWQRARRFCRDNYTDLVAIQNKAEIEYLEKTLPFSRSYYWIGIRKIGGIWTWVGTNKSLTEEAENWGDGEPNNKKNKEDCVEIYIKRNKDAGKWNDDACHKLKAALCYTASCQPWSCSGHGECVEIINNYTCNCDVGYYGPQCQFVIQCEPLEAPELGTMDCTHPLGNFSFSSQCAFSCSEGTNLTGIEETTCGPFGNWSSPEPTCQVIQCEPLSAPDLGIMNCSHPLASFSFTSACTFICSEGTELIGKKKTICESSGIWSNPSPICQKLDKSFSMIKEGDYN

SEQ ID NO: 7242 - protein, 243 aa, Artificial Sequence
  source: /note="Description of Artificial Sequence: Synthetic polypeptide"
RYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 7243 - protein, 124 aa, Artificial Sequence
  source: /note="Description of Artificial Sequence: Synthetic polypeptide"
KLTRDSQSLCPYDWIGFQNKCYYFSKEEGDWNSSKYNCSTQHADLTIIDNIEEMNFLRRYKCSSDHWIGLKMAKNRTGQWVDGATFTKSFGMRGSEGCAYLSDDGAATARCYTERKWICRKRIH

SEQ ID NO: 7244 - protein, 194 aa, Artificial Sequence
  source: /note="Description of Artificial Sequence: Synthetic polypeptide"
QGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARS

SEQ ID NO: 7245 - protein, 133 aa, Artificial Sequence
  source: /note="Description of Artificial Sequence: Synthetic polypeptide"
QVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 7246 - protein, 149 aa, Artificial Sequence
  source: /note="Description of Artificial Sequence: Synthetic polypeptide"
MQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 7247 - protein, 205 aa, Artificial Sequence
  source: /note="Description of Artificial Sequence: Synthetic polypeptide"
ACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 7248 - protein, 455 aa, Artificial Sequence
  source: /note="Description of Artificial Sequence: Synthetic polypeptide"
LNFRAPPVIPNVPFLWAWNAPSEFCLGKFDEPLDMSLFSFIGSPRINATGQGVTIFYVDRLGYYPYIDSITGVTVNGGIPQKISLQDHLDKAKKDITFYMPVDNLGMAVIDWEEWRPTWARNWKPKDVYKNRSIELVQQQNVQLSLTEATEKAKQEFEKAGKDFLVETIKLGKLLRPNHLWGYYLFPDCYNHHYKKPGYNGSCFNVEIKRNDDLSWLWNESTALYPSIYLNTQQSPVAATLYVRNRVREAIRVSKIPDAKSPLPVFAYTRIVFTDQVLKFLSQDELVYTFGETVALGASGIVIWGTLSIMRSMKSCLLLDNYMETILNPYIINVTLAAKMCSQVLCQEQGVCIRKNWNSSDYLHLNPDNFAIQLEKGGKFTVRGKPTLEDLEQFSEKFYCSCYSTLSCKEKADVKDTDAVDVCIADGVCIDAFLKPPMETEEPQIFYNASPSTLS

SEQ ID NO: 7249 - protein, 5 aa, Artificial Sequence
  source: /note="Description of Artificial Sequence: Synthetic peptide"
GGGGS

SEQ ID NO: 7250 - protein, 10 aa, Artificial Sequence
  source: /note="Description of Artificial Sequence: Synthetic peptide"
GGGGSGGGGS

SEQ ID NO: 7251 - protein, 15 aa, Artificial Sequence
  source: /note="Description of Artificial Sequence: Synthetic peptide"
GGGGSGGGGSGGGGS

SEQ ID NO: 7252 - protein, 17 aa, Artificial Sequence
  source: /note="Description of Artificial Sequence: Synthetic peptide"
DVPSGPGGGGGSGGGGS

SEQ ID NO: 7253 - protein, 413 aa, Artificial Sequence
  source: /note="Description of Artificial Sequence: Synthetic polypeptide"
FRGPLLPNRPFTTVWNANTQWCLERHGVDVDVSVFDVVANPGQTFRGPDMTIFYSSQGTYPYYTPTGEPVFGGLPQNASLIAHLARTFQDILAAIPAPDFSGLAVIDWEAWRPRWAFNWDTKDIYRQRSRALVQAQHPDWPAPQVEAVAQDQFQGAARAWMAGTLQLGRALRPRGLWGFYGFPDCYNYDFLSPNYTGQCPSGIRAQNDQLGWLWGQSRALYPSIYMPAVLEGTGKSQMYVQHRVAEAFRVAVAAGDPNLPVLPYVQIFYDTTNHFLPLDELEHSLGESAAQGAAGVVLWVSWENTRTKESCQAIKEYMDTTLGPFILNVTSGALLCSQALCSGHGRCVRRTSHPKALLLLNPASFSIQLTPGGGPLSLRGALSLEDQAQMAVEFKCRCYPGWQAPWCERKSMW

SEQ ID NO: 7254 - protein, 551 aa, Artificial Sequence
  source: /note="Description of Artificial Sequence: Synthetic polypeptide"
YNFFPRKPKWDKNQITYRIIGYTPDLDPETVDDAFARAFQVWSDVTPLRFSRIHDGEADIMINFGRWEHGDGYPFDGKDGLLAHAFAPGTGVGGDSHFDDDELWTLGEGQVVRVKYGNADGEYCKFPFLFNGKEYNSCTDTGRSDGFLWCSTTYNFEKDGKYGFCPHEALFTMGGNAEGQPCKFPFRFQGTSYDSCTTEGRTDGYRWCGTTEDYDRDKKYGFCPETAMSTVGGNSEGAPCVFPFTFLGNKYESCTSAGRSDGKMWCATTANYDDDRKWGFCPDQGYSLFLVAAHEFGHAMGLEHSQDPGALMAPIYTYTKNFRLSQDDIKGIQELYGASPDIDLGTGPTPTLGPVTPEICKQDIVFDGIAQIRGEIFFFKDRFIWRTVTPRDKPMGPLLVATFWPELPEKIDAVYEAPQEEKAVFFAGNEYWIYSASTLERGYPKPLTSLGLPPDVQRVDAAFNWSKNKKTYIFAGDKFWRYNEVKKKMDPGFPKLIADAWNAIPDNLDAVVDLQGGGHSYFFKGAYYLKLENQSLKSVKFGSIKSDWLGC

SEQ ID NO: 7255 - protein, 27 aa, Artificial Sequence
  source: /note="Description of Artificial Sequence: Synthetic peptide"
  SITE (2)..(26): /note="This region may encompass 2-5 'Glu Ala Ala Ala Lys' repeating units"
AEAAAKEAAAKEAAAKEAAAKEAAAKA

SEQ ID NO: 7256 - protein, 455 aa, Artificial Sequence; identical to SEQ ID NO: 7248
  source: /note="Description of Artificial Sequence: Synthetic polypeptide"

SEQ ID NO: 7257-7291 - skipped (35 entries)

SEQ ID NO: 7292 - protein, 32 aa, Artificial Sequence
  source: /note="Description of Artificial Sequence: Synthetic polypeptide"
GIPDQFSGSNSGNIATLTISKAQAGYEADYYC

SEQ ID NO: 7293 - protein, 10 aa, Artificial Sequence
  source: /note="Description of Artificial Sequence: Synthetic peptide"
QSWDSTNSAV

SEQ ID NO: 7294 - protein, 107 aa, Artificial Sequence
  source: /note="Description of Artificial Sequence: Synthetic polypeptide"
SYTLTQPPLLSVALGHKATITCSGERLSDKYVHWYQQKPGRAPVMVIYENDKRPSGIPDQFSGSNSGNIATLTISKAQAGYEADYYCQSWDSTNSAVFGSGTQLTVL

SEQ ID NO: 7295 - protein, 118 aa, Artificial Sequence
  source: /note="Description of Artificial Sequence: Synthetic polypeptide"
QIQLQESGPGLVKPSQSLSLSCSVTGFSINTGGYHWNWIRQFPGKKVEWMGYIYSSGTTKYNPSLKSRISITRDTSKNQFFLQLNSVTTEDTATYYCARGDWHYFDYWGQGTMVAVSS

SEQ ID NO: 7296 - protein, 107 aa, Artificial Sequence
  source: /note="Description of Artificial Sequence: Synthetic polypeptide"
SYTLTQPPLVSVALGQKATIICSGENLSDKYVHWYQQKPGRAPVMVIYENDKRPSGIPDQFSGSNSGNIATLTISKAQAGYEADYYCHCWDSTNSAVFGSGTHLTVL

SEQ ID NO: 7297 - protein, 118 aa, Artificial Sequence
  source: /note="Description of Artificial Sequence: Synthetic polypeptide"
QIQLQESGPGLVKPSQSLSLTCSVTGFSINTGGYHWNWIRQFPGKKLEWMGYIYSSGSTRYNPSLKSRFSITRDTSKNQFFLQLNSVTTEDTATYYCTRGNWHYFDYWGQGTLVAVSS

SEQ ID NO: 7298 - protein, 118 aa, Artificial Sequence
  source: /note="Description of Artificial Sequence: Synthetic polypeptide"
QIQLQESGPGLVKPSQSLSLSCSVTGFSITTTGYHWNWIRQFPGKKLEWMGYIYSSGSTSYNPSLKSRFSITRDTSKNQFFLQLNSVTTEDTATYYCARGDWHYFDYWGPGTMVTVSS

SEQ ID NO: 7299 - protein, 107 aa, Artificial Sequence
  source: /note="Description of Artificial Sequence: Synthetic polypeptide"
SFTLTQPPLVSVAVGQVATITCSGEKLSDKYVHWYQQKPGRAPVMVIYENDRRPSGIPDQFSGSNSGNIASLTISKAQAGDEADYFCQFWDSTNSAVFGGGTQLTVL

SEQ ID NO: 7300 - protein, 118 aa, Artificial Sequence
  source: /note="Description of Artificial Sequence: Synthetic polypeptide"
QIQLQESGPGLVKPSQTLSLTCTVSGFSITTTGYHWNWIRQHPGKGLEWIGYIYSSGSTSYNPSLKSLVTISRDTSKNQFSLKLSSVTAADTAVYYCARGDWHYFDYWGQGTMVTVSS

SEQ ID NO: 7301 - protein, 118 aa, Artificial Sequence
  source: /note="Description of Artificial Sequence: Synthetic polypeptide"
QIQLVESGGGLVKPGGSLRLSCAVSGFSITTTGYHWNWIRQAPGKGLEWVGYIYSSGSTSYNPSLKSRFTISRDTAKNSFYLQMNSLRAEDTAVYYCARGDWHYFDYWGQGTMVTVSS

SEQ ID NO: 7302 - protein, 118 aa, Artificial Sequence
  source: /note="Description of Artificial Sequence: Synthetic polypeptide"
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSS

SEQ ID NO: 7303 - protein, 118 aa, Artificial Sequence
  source: /note="Description of Artificial Sequence: Synthetic polypeptide"
EIQLVESGGGLVQPGGSLRLSCAVSGFSITTTGYHWNWVRQAPGKGLEWVGYIYSSGSTSYNPSLKSRFTISRDTAKNSFYLQMNSLRAEDTAVYYCARGDWHYFDYWGQGTMVTVSS

SEQ ID NO: 7304 - protein, 118 aa, Artificial Sequence
  source: /note="Description of Artificial Sequence: Synthetic polypeptide"
QIQLVQSGAEVKKPGASVKVSCKVSGFSITTTGYHWNWVRQAPGQGLEWMGYIYSSGSTSYNPSLKSRVTMTRDTSTNTFYMELSSLRSEDTAVYYCARGDWHYFDYWGQGTMVTVSS

SEQ ID NO: 7305 - protein, 107 aa, Artificial Sequence
  source: /note="Description of Artificial Sequence: Synthetic polypeptide"
SSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVL

SEQ ID NO: 7306 - protein, 107 aa, Artificial Sequence
  source: /note="Description of Artificial Sequence: Synthetic polypeptide"
SSETTQPHSVSVATAQMARITCSGEKLSDKYVHWYQQKPGQDPVMVIYENDRRPSGIPERFSGSNPGNTATLTISRIEAGDEADYFCQFWDSTNSAVFGGGTQLTVL

SEQ ID NO: 7307 - protein, 107 aa, Artificial Sequence
  source: /note="Description of Artificial Sequence: Synthetic polypeptide"
QSVTTQPPSASGTPGQRVTISCSGEKLSDKYVHWYQQLPGTAPKMLIYENDRRPSGVPDRFSGSNSGNSASLAISGLRSEDEADYFCQFWDSTNSAVFGGGTQLTVL

SEQ ID NO: 7308 - protein, 107 aa, Artificial Sequence
  source: /note="Description of Artificial Sequence: Synthetic polypeptide"
QSVTTQPPSVSGAPGQRVTISCSGEKLSDKYVHWYQQLPGTAPKMLIYENDRRPSGVPDRFSGSNSGNSASLAITGLQAEDEADYFCQFWDSTNSAVFGGGTQLTVL

SEQ ID NO: 7309 - protein, 108 aa, Artificial Sequence
  source: /note="Description of Artificial Sequence: Synthetic polypeptide"
DSVTTQSPLSLPVTLGQPASISCSGEKLSDKYVHWYQQRPGQSPRMLIYENDRRPSGVPDRFSGSNSGNDATLKISRVEAEDVGVYFCQFWDSTNSAVFGGGTKVEIK

SEQ ID NO: 7310 - protein, 245 aa, Artificial Sequence
  source: /note="Description of Artificial Sequence: Synthetic polypeptide"
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSSSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVL

SEQ ID NO: 7311 - protein, 246 aa, Artificial Sequence
  source: /note="Description of Artificial Sequence: Synthetic polypeptide"
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSDSVTTQSPLSLPVTLGQPASISCSGEKLSDKYVHWYQQRPGQSPRMLIYENDRRPSGVPDRFSGSNSGNDATLKISRVEAEDVGVYFCQFWDSTNSAVFGGGTKVEIK

SEQ ID NO: 7312 - protein, 32 aa, Artificial Sequence
  source: /note="Description of Artificial Sequence: Synthetic polypeptide"
QIQLQESGPGLVKPSQSLSLSCSVTGFSINTG

SEQ ID NO: 7313 - protein, 5 aa, Artificial Sequence
  source: /note="Description of Artificial Sequence: Synthetic peptide"
GYHWN

SEQ ID NO: 7314 - protein, 14 aa, Artificial Sequence
  source: /note="Description of Artificial Sequence: Synthetic peptide"
WIRQFPGKKVEWMG

SEQ ID NO: 7315 - protein, 8 aa, Artificial Sequence
  source: /note="Description of Artificial Sequence: Synthetic peptide"
GDWHYFDY

SEQ ID NO: 7316 - protein, 11 aa, Artificial Sequence
  source: /note="Description of Artificial Sequence: Synthetic peptide"
WGQGTMVAVSS

SEQ ID NO: 7317 - protein, 32 aa, Artificial Sequence
  source: /note="Description of Artificial Sequence: Synthetic polypeptide"
QIQLQESGPGLVKPSQSLSLTCSVTGFSINTG

SEQ ID NO: 7318 - protein, 16 aa, Artificial Sequence
  source: /note="Description of Artificial Sequence: Synthetic peptide"
YIYSSGSTRYNPSLKS

SEQ ID NO: 7319 - protein, 32 aa, Artificial Sequence
  source: /note="Description of Artificial Sequence: Synthetic polypeptide"
RFSITRDTSKNQFFLQLNSVTTEDTATYYCTR

SEQ ID NO: 7320 - protein, 22 aa, Artificial Sequence
  source: /note="Description of Artificial Sequence: Synthetic peptide"
SYTLTQPPLVSVALGQKATIIC

SEQ ID NO: 7321 - protein, 10 aa, Artificial Sequence
  source: /note="Description of Artificial Sequence: Synthetic peptide"
HCWDSTNSAV

SEQ ID NO: 7322 - protein, 32 aa, Artificial Sequence
  source: /note="Description of Artificial Sequence: Synthetic polypeptide"
QIQLQESGPGLVKPSQSLSLSCSVTGFSITTT

SEQ ID NO: 7323 - protein, 32 aa, Artificial Sequence
  source: /note="Description of Artificial Sequence: Synthetic polypeptide"
RFSITRDTSKNQFFLQLNSVTTEDTATYYCAR

SEQ ID NO: 7324 - protein, 11 aa, Artificial Sequence
  source: /note="Description of Artificial Sequence: Synthetic peptide"
WGPGTMVTVSS

SEQ ID NO: 7325 - protein, 22 aa, Artificial Sequence
  source: /note="Description of Artificial Sequence: Synthetic peptide"
SFTLTQPPLVSVAVGQVATITC

SEQ ID NO: 7326 - protein, 11 aa, Artificial Sequence
  source: /note="Description of Artificial Sequence: Synthetic peptide"
SGEKLSDKYVH

SEQ ID NO: 7327 - protein, 7 aa, Artificial Sequence
  source: /note="Description of Artificial Sequence: Synthetic peptide"
ENDRRPS

SEQ ID NO: 7328 - protein, 32 aa, Artificial Sequence
  source: /note="Description of Artificial Sequence: Synthetic polypeptide"
GIPDQFSGSNSGNIASLTISKAQAGDEADYFC

SEQ ID NO: 7329 - protein, 10 aa, Artificial Sequence
  source: /note="Description of Artificial Sequence: Synthetic peptide"
QFWDSTNSAV

SEQ ID NO: 7330 - protein, 32 aa, Artificial Sequence
  source: /note="Description of Artificial Sequence: Synthetic polypeptide"
QIQLQESGPGLVKPSQTLSLTCTVSGFSITTT

SEQ ID NO: 7331 - protein, 32 aa, Artificial Sequence
  source: /note="Description of Artificial Sequence: Synthetic polypeptide"
QIQLVESGGGLVKPGGSLRLSCAVSGFSITTT

SEQ ID NO: 7332 - protein, 32 aa, Artificial Sequence
  source: /note="Description of Artificial Sequence: Synthetic polypeptide"
EIQLLESGGGLVQPGGSLRLSCAVSGFSITTT

SEQ ID NO: 7333 - protein, 32 aa, Artificial Sequence
  source: /note="Description of Artificial Sequence: Synthetic polypeptide"
EIQLVESGGGLVQPGGSLRLSCAVSGFSITTT

SEQ ID NO: 7334 - protein, 32 aa, Artificial Sequence
  source: /note="Description of Artificial Sequence: Synthetic polypeptide"
QIQLVQSGAEVKKPGASVKVSCKVSGFSITTT

SEQ ID NO: 7335 - protein, 22 aa, Artificial Sequence
  source: /note="Description of Artificial Sequence: Synthetic peptide"
SSETTQPPSVSVSPGQTASITC

SEQ ID NO: 7336 - protein, 32 aa, Artificial Sequence
  source: /note="Description of Artificial Sequence: Synthetic polypeptide"
GIPERFSGSNSGNTATLTISGTQAMDEADYFC

SEQ ID NO: 7337 - protein, 32 aa, Artificial Sequence
  source: /note="Description of Artificial Sequence: Synthetic polypeptide"
GIPERFSGSNPGNTATLTISRIEAGDEADYFC

SEQ ID NO: 7338 - protein, 32 aa, Artificial Sequence
  source: /note="Description of Artificial Sequence: Synthetic polypeptide"
GVPDRFSGSNSGNSASLAISGLRSEDEADYFC

SEQ ID NO: 7339 - protein, 32 aa, Artificial Sequence
  source: /note="Description of Artificial Sequence: Synthetic polypeptide"
GVPDRFSGSNSGNSASLAITGLQAEDEADYFC

SEQ ID NO: 7340 - protein, 23 aa, Artificial Sequence
  source: /note="Description of Artificial Sequence: Synthetic peptide"
DSVTTQSPLSLPVTLGQPASISC

SEQ ID NO: 7341 - protein, 15 aa, Artificial Sequence
  source: /note="Description of Artificial Sequence: Synthetic peptide"
WYQQRPGQSPRMLIY

SEQ ID NO: 7342 - protein, 32 aa, Artificial Sequence
  source: /note="Description of Artificial Sequence: Synthetic polypeptide"
GVPDRFSGSNSGNDATLKISRVEAEDVGVYFC

SEQ ID NO: 7343 - protein, 124 aa, Artificial Sequence
  source: /note="Description of Artificial Sequence: Synthetic polypeptide"
QVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTTVTVSS

SEQ ID NO: 7344 - protein, 124 aa, Artificial Sequence
  source: /note="Description of Artificial Sequence: Synthetic polypeptide"
QVQLVQSGAEVKKPGASVKVSCKASGYTFTGYVMHWVRQAPGQGLEWMGFINPYNDDIQSNERFRGRVTMTSDKSITTAYMELSRLRSDDTAVYYCARGAGYNFDGAYRFFDFWGQGTTVTVSS

SEQ ID NO: 7345 - protein, 30 aa, Artificial Sequence
  source: /note="Description of Artificial Sequence: Synthetic polypeptide"
QVQLVQSGAEVKKPGSSVKVSCKASGYTFT

SEQ ID NO: 7346 - protein, 5 aa, Artificial Sequence
  source: /note="Description of Artificial Sequence: Synthetic peptide"
GYVMH

SEQ ID NO: 7347 - protein, 11 aa, Artificial Sequence
  source: /note="Description of Artificial Sequence: Synthetic peptide"
WGQGTTVTVSS

SEQ ID NO: 7348 - protein, 30 aa, Artificial Sequence
  source: /note="Description of Artificial Sequence: Synthetic polypeptide"
QVQLVQSGAEVKKPGASVKVSCKASGYTFT

SEQ ID NO: 7349 - protein, 32 aa, Artificial Sequence
  source: /note="Description of Artificial Sequence: Synthetic polypeptide"
RVTMTSDKSITTAYMELSRLRSDDTAVYYCAR

SEQ ID NO: 7350 - protein, 124 aa, Artificial Sequence
  source: /note="Description of Artificial Sequence: Synthetic polypeptide"
QVQLVQSGAEVKKPGSSVKVSCKASGYTFSGYAISWVRQAPGQGLEWMGFINPYNDDIQSNERFRGRVTITSDKSTTTAYMELSSLRSEDTAVYYCARGAGYNFDGAYRFFDFWGQGTLVTVSS

SEQ ID NO: 7351 - protein, 124 aa, Artificial Sequence
  source: /note="Description of Artificial Sequence: Synthetic polypeptide"
QVQLVQSGAEVKKPGSSVKVSCKASGYTFTGYVMHWVRQAPGQGLEWMGFIIPIFGTANYAQKFQGRVTITSDKSTTTAYMELSSLRSEDTAVYYCARGAGYNFDGAYRFFDFWGQGTLVTVSS

SEQ ID NO: 7352 - protein, 124 aa, Artificial Sequence
  source: /note="Description of Artificial Sequence: Synthetic polypeptide"
QVQLVQSGAEVKKPGSSVKVSCKASGYTFSGYAISWVRQAPGQGLEWMGFIIPIFGTANYAQKFQGRVTITSDKSTTTAYMELSSLRSEDTAVYYCARGAGYNFDGAYRFFDFWGQGTLVTVSS

SEQ ID NO: 7353 - protein, 30 aa, Artificial Sequence
  source: /note="Description of Artificial Sequence: Synthetic polypeptide"
QVQLVQSGAEVKKPGSSVKVSCKASGYTFS

SEQ ID NO: 7354 - protein, 5 aa, Artificial Sequence
  source: /note="Description of Artificial Sequence: Synthetic peptide"
GYAIS

SEQ ID NO: 7355 - protein, 17 aa, Artificial Sequence
  source: /note="Description of Artificial Sequence: Synthetic peptide"
FIIPIFGTANYAQKFQG

SEQ ID NO: 7356 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGGGTKVEIK

SEQ ID NO: 7357 - protein, 111 aa, Artificial Sequence
  source: /note="Description of Artificial Sequence: Synthetic polypeptide"
DVVMTQSPLSLPVTLGQPASISCRSSQSLVYSDGNTYHWYQQRPGQSPRLLIYRVSNRFPGVPDRFSGSGSGTDFTLKISRVEAEDVGVYFCSQSTHVPYTFGGGTKVEIK

SEQ ID NO: 7358 - protein, 112 aa, Artificial Sequence
  source: /note="Description of Artificial Sequence: Synthetic polypeptide"
DVVMTQSPLSLPVTLGQPASISCRSSQRLVHSNGNTYLHWYQQRPGQSPRLLIYKVSNRDSGVPDRFSGSGSGTDFTLKISRVEAEDVGVYFCSQSTHVPYTFGGGTKVEIK

SEQ ID NO: 7359 - protein, 112 aa, Artificial Sequence
  source: /note="Description of Artificial Sequence: Synthetic polypeptide"
DVVMTQSPLSLPVTLGQPASISCRSSQRLVHSNGNTYLHWYQQRPGQSPRLLIYRVSNRFPGVPDRFSGSGSGTDFTLKISRVEAEDVGVYFCMQSTHWPYTFGGGTKVEIK

SEQ ID NO: 7360 - protein, 111 aa, Artificial Sequence
  source: /note="Description of Artificial Sequence: Synthetic polypeptide"
DVVMTQSPLSLPVTLGQPASISCRSSQSLVYSDGNTYHWYQQRPGQSPRLLIYKVSNRDSGVPDRFSGSGSGTDFTLKISRVEAEDVGVYFCMQSTHWPYTFGGGTKVEIK

SEQ ID NO: 7361 - protein, 23 aa, Artificial Sequence
  source: /note="Description of Artificial Sequence: Synthetic peptide"
DIQMTQSPSSLSASVGDRVTITC

SEQ ID NO: 7362 - protein, 11 aa, Artificial Sequence
  source: /note="Description of Artificial Sequence: Synthetic peptide"
RASQSISSYLN

SEQ ID NO: 7363 - protein, 15 aa, Artificial Sequence
  source: /note="Description of Artificial Sequence: Synthetic peptide"
WYQQKPGKAPKLLIY

SEQ ID NO: 7364 - protein, 7 aa, Artificial Sequence
  source: /note="Description of Artificial Sequence: Synthetic peptide"
AASSLQS

SEQ ID NO: 7365 - protein, 32 aa, Artificial Sequence
  source: /note="Description of Artificial Sequence: Synthetic polypeptide"
GVPSRFSGSGSGTDFTLTISSLQPEDFATYYC

SEQ ID NO: 7366 - protein, 9 aa, Artificial Sequence
  source: /note="Description of Artificial Sequence: Synthetic peptide"
QQSYSTPYT

SEQ ID NO: 7367 - protein, 15 aa, Artificial Sequence
  source: /note="Description of Artificial Sequence: Synthetic peptide"
RSSQSLVYSDGNTYH

SEQ ID NO: 7368 - protein, 7 aa, Artificial Sequence
  source: /note="Description of Artificial Sequence: Synthetic peptide"
KVSNRDS

SEQ ID NO: 7369 - protein, 9 aa, Artificial Sequence
  source: /note="Description of Artificial Sequence: Synthetic peptide"
MQSTHWPYT

SEQ ID NO: 7370 - protein, 30 aa, Artificial Sequence
  source: /note="Description of Artificial Sequence: Synthetic polypeptide"
EVRLQQSGPDLIKPGASVKMSCKASGYTFT

SEQ ID NO: 7371 - protein, 32 aa, Artificial Sequence
  source: /note="Description of Artificial Sequence: Synthetic polypeptide"
QIQLQESGPGLVKPSETLSLTCTVSGFSINTG

SEQ ID NO: 7372 - protein, 32 aa, Artificial Sequence
  source: /note="Description of Artificial Sequence: Synthetic polypeptide"
QIQLQESGPGLVKPSQTLSLTCTVSGFSINTG

SEQ ID NO: 7373 - protein, 32 aa, Artificial Sequence
  source: /note="Description of Artificial Sequence: Synthetic polypeptide"
EIQLLESGGGLVQPGGSLRLSCAVSGFSINTG

SEQ ID NO: 7374 - protein, 32 aa, Artificial Sequence
  source: /note="Description of Artificial Sequence: Synthetic polypeptide"
QIQLVQSGAEVKKPGSSVKVSCKVSGFSINTG

SEQ ID NO: 7375 - protein, 32 aa, Artificial Sequence
  source: /note="Description of Artificial Sequence: Synthetic polypeptide"
EIQLVESGGGLVQPGGSLRLSCAVSGFSINTG

SEQ ID NO: 7376 - protein, 32 aa, Artificial Sequence
  source: /note="Description of Artificial Sequence: Synthetic polypeptide"
QIQLVQSGAEVKKPGASVKVSCKVSGFSINTG

SEQ ID NO: 7377 - protein, 32 aa, Artificial Sequence
  source: /note="Description of Artificial Sequence: Synthetic polypeptide"
QIQLVESGGGLVKPGGSLRLSCAVSGFSINTG

SEQ ID NO: 7378 - protein, 32 aa, Artificial Sequence
  source: /note="Description of Artificial Sequence: Synthetic polypeptide"
EIQLVQSGAEVKKPGATVKISCKVSGFSINTG

SEQ ID NO: 7379 - protein, 454 aa, Artificial Sequence
  source: /note="Description of Artificial Sequence: Synthetic polypeptide"
QVQLVQSGAEVKKPGSSVKVSCKASGYTFTGYVMHWVRQAPGQGLEWMGFINPYNDDIQSNERFRGRVTITSDKSTTTAYMELSSLRSEDTAVYYCARGAGYNFDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7380 - protein, 219 aa, Artificial Sequence
  source: /note="Description of Artificial Sequence: Synthetic polypeptide"
DVVMTQSPLSLPVTLGQPASISCRSSQRLVHSNGNTYLHWYQQRPGQSPRLLIYRVSNRFPGVPDRFSGSGSGTDFTLKISRVEAEDVGVYFCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7381 - protein, 472 aa, Artificial Sequence
  source: /note="Description of Artificial Sequence: Synthetic polypeptide"
QIQLQESGPGLVKPSQSLSLSCSVTGFSITTTGYHWNWIRQFPGKKLEWMGYIYSSGSTSYNPSLKSRFSITRDTSKNQFFLQLNSVTTEDTATYYCARGDWHYFDYWGPGTMVTVSSGGGGSGGGGSGGGGSGGGGSSFTLTQPPLVSVAVGQVATITCSGEKLSDKYVHWYQQKPGRAPVMVIYENDRRPSGIPDQFSGSNSGNIASLTISKAQAGDEADYFCQFWDSTNSAVFGGGTQLTVLDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 7382 - protein, 454 aa, Artificial Sequence
  source: /note="Description of Artificial Sequence: Synthetic polypeptide"
QVQLVQSGAEVKKPGSSVKVSCKASGYTFTGYVMHWVRQAPGQGLEWMGFIIPIFGTANYAQKFQGRVTITSDKSTTTAYMELSSLRSEDTAVYYCARGAGYNFDGAYRFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7383 - protein, 473 aa, Artificial Sequence
  source: /note="Description of Artificial Sequence: Synthetic polypeptide"
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSDSVTTQSPLSLPVTLGQPASISCSGEKLSDKYVHWYQQRPGQSPRMLIYENDRRPSGVPDRFSGSNSGNDATLKISRVEAEDVGVYFCQFWDSTNSAVFGGGTKVEIKDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 7384 - protein, 472 aa, Artificial Sequence
  source: /note="Description of Artificial Sequence: Synthetic polypeptide"
EIQLLESGGGLVQPGGSLRLSCAVSGFSITTTGYHWNWVRQAPGKGLEWVGYIYSSGSTSYNPSLKSRFTISRDTSKNTFYLQMNSLRAEDTAVYYCARGDWHYFDYWGQGTMVTVSSGGGGSGGGGSGGGGSGGGGSSSETTQPPSVSVSPGQTASITCSGEKLSDKYVHWYQQKPGQSPVMVIYENDRRPSGIPERFSGSNSGNTATLTISGTQAMDEADYFCQFWDSTNSAVFGGGTQLTVLDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 7385 - protein, 16 aa, Artificial Sequence
  source: /note="Description of Artificial Sequence: Synthetic peptide"
YIYSSGTTKYNPSLKS

We claim:
1. A multifunctional molecule, comprising:
(a) a first antigen binding domain that selectively binds to T cell receptor beta chain constant domain 1 (TRBC1); wherein the first antigen binding domain comprises:
(i) a heavy chain variable region (VH) comprising a heavy chain complementarity determining region 1 (VHCDR1), a heavy chain complementarity determining region 2 (VHCDR2), and a heavy chain complementarity determining region 3 (VHCDR3) of SEQ ID NO: 7346, SEQ ID NO: 7355, and SEQ ID NO: 202, respectively; and a light chain variable region (VL) comprising a light chain complementarity determining region 1 (VLCDR1), a light chain complementarity determining region 2 (VLCDR2), and a light chain complementarity determining region 3 (VLCDR3) of: SEQ ID NO: 223, SEQ ID NO: 224, and SEQ ID NO: 225, respectively;
(ii) a VH comprising a VHCDR1, a VHCDR2, and a VHCDR3 of SEQ ID NO: 200, SEQ ID NO: 7355, and SEQ ID NO: 202, respectively; and a VL comprising a VLCDR1, a VLCDR2, and a VLCDR3 of SEQ ID NO: 223, SEQ ID NO: 224, and SEQ ID NO: 225, respectively;
(iii) a VH comprising a VHCDR1, a VHCDR2, and a VHCDR3 of SEQ ID NO: 200, SEQ ID NO: 201, and SEQ ID NO: 202, respectively; and a VL comprising a VLCDR1, a VLCDR2, and a VLCDR3 of SEQ ID NO: 223, SEQ ID NO: 224, and SEQ ID NO: 225, respectively;
(iv) a VH comprising a VHCDR1, a VHCDR2, and a VHCDR3 of SEQ ID NO: 7346, SEQ ID NO: 201, and SEQ ID NO: 202, respectively; and a VL comprising a VLCDR1, a VLCDR2, and a VLCDR3 of SEQ ID NO: 223, SEQ ID NO: 224, and SEQ ID NO: 225, respectively;
(v) a VH comprising a VHCDR1, a VHCDR2, and a VHCDR3 of SEQ ID NO: 7354, SEQ ID NO: 201, and SEQ ID NO: 202, respectively; and a VL com- prising a VLCDR1, a VLCDR2, and a VLCDR3 of SEQ ID NO: 7367, SEQ ID NO: 224, and SEQ ID NO: 225, respectively;
(vi) a VH comprising a VHCDR1, a VHCDR2, and a VHCDR3 of SEQ ID NO: 7346, SEQ ID NO: 7355, and SEQ ID NO: 202, respectively; and a VL comprising a VLCDR1, a VLCDR2, and a VLCDR3 of SEQ ID NO: 223, SEQ ID NO: 7368, and SEQ ID NO: 225, respectively; or
(vii) a VH comprising a VHCDR1, a VHCDR2, and a VHCDR3 of SEQ ID NO: 7354, SEQ ID NO: 7355, and SEQ ID NO: 202, respectively; and a VL comprising a VLCDR1, a VLCDR2, and a VLCDR3 of SEQ ID NO: 7367, SEQ ID NO: 7368, and SEQ ID NO: 739, respectively; and (b) a second antigen binding domain that selectively binds to NKp30; wherein the second antigen binding domain comprises:
(i) a VH comprising a VHCDR1, a VHCDR2, and a VHCDR3 of SEQ ID NO: 7313, SEQ ID NO: 6001, and SEQ ID NO: 7315, respectively; and a VL comprising a VLCDR1, a VLCDR2, and a VLCDR3 of SEQ ID NO: 7326, SEQ ID NO: 7327, and SEQ ID NO: 7329, respectively;
(ii) a VH comprising a VHCDR1, a VHCDR2, and a VHCDR3 of SEQ ID NO: 7313, SEQ ID NO: 6001, and SEQ ID NO: 6002, respectively; and a VL comprising a VLCDR1, a VLCDR2, and a VLCDR3 of SEQ ID NO: 7326, SEQ ID NO: 7327, and SEQ ID NO: 7329, respectively;
(iii) a VH comprising a VHCDR1, a VHCDR2, and a VHCDR3 of SEQ ID NO: 7313, SEQ ID NO: 6001, and SEQ ID NO: 6002, respectively; and a VL comprising a VLCDR1, a VLCDR2, and a VLCDR3 of SEQ ID NO: 6063, SEQ ID NO: 6064, and SEQ ID NO: 7293, respectively;
(iv) a VH comprising a VHCDR1, a VHCDR2, and a VHCDR3 of SEQ ID NO: 7313, SEQ ID NO: 6008, and SEQ ID NO: 6009, respectively; and a VL comprising a VLCDR1, a VLCDR2, and a VLCDR3 of SEQ ID NO: 6070, SEQ ID NO: 6071, and SEQ ID NO: 6072, respectively;
(v) a VH comprising a VHCDR1, a VHCDR2, and a VHCDR3 of SEQ ID NO: 7313, SEQ ID NO: 7385, and SEQ ID NO: 7315, respectively; and a VL comprising a VLCDR1, a VLCDR2, and a VLCDR3 of SEQ ID NO: 6070, SEQ ID NO: 6064, and SEQ ID NO: 7321, respectively; or
(vi) a VH comprising a VHCDR1, a VHCDR2, and a VHCDR3 of SEQ ID NO: 7313, SEQ ID NO: 7318, and SEQ ID NO: 6009, respectively; and a VL comprising a VLCDR1, a VLCDR2, and a VLCDR3 of SEQ ID NO: 6070, SEQ ID NO: 6064, and SEQ ID NO: 7321, respectively.

2. The multifunctional molecule of claim 1, wherein the first antigen binding domain comprises:
(a) the VH comprising
(i) the VHCDR1 amino acid sequence of SEQ ID NO: 7346,
(ii) the VHCDR2 amino acid sequence of SEQ ID NO: 7355 or SEQ ID NO: 201, and
(iii) the VHCDR3 amino acid sequence of SEQ ID NO: 202; and
(b) the VL comprising
(i) the VLCDR1 amino acid sequence of SEQ ID NO: 223,
(ii) the VLCDR2 amino acid sequence of SEQ ID NO: 224, and
(iii) the VLCDR3 amino acid sequence of SEQ ID NO: 225.

3. The multifunctional molecule of claim 2, wherein the first antigen binding domain comprises:
(a) the VH comprising:
(i) a heavy chain framework region 1 (VHFWR1) amino acid sequence with at least 90% sequence identity to SEQ ID NO: 203,
(ii) a VHFWR2 amino acid sequence with at least 90% sequence identity to SEQ ID NO: 204,
(iii) a VHFWR3 amino acid sequence with at least 90% sequence identity to SEQ ID NO: 205, and
(iv) a VHFWR4 amino acid sequence with at least 90% sequence identity to SEQ ID NO: 206; and/or
(b) the VL comprising:
(i) a light chain framework region 1 (VLFWR1) amino acid sequence with at least 90% sequence identity to SEQ ID NO: 226,
(ii) a VLFWR2 amino acid sequence with at least 90% sequence identity to SEQ ID NO: 227,
(iii) a VLFWR3 amino acid sequence with at least 90% sequence identity to SEQ ID NO: 228, and
(iv) a VLFWR4 amino acid sequence with at least 90% sequence identity to SEQ ID NO: 229.

4. The multifunctional molecule of claim 1, wherein the first antigen binding domain comprises:
(a) the VH comprising an amino acid sequence with at least 75% sequence identity to any one of SEQ ID NOs: 250-254, 7343, 7344, and 7350-7352; and
(b) the VL comprising an amino acid sequence with at least 75% sequence identity to any one of SEQ ID NOs: 255-260 and 7357-7360.

5. The multifunctional molecule of claim 2, wherein the first antigen binding domain comprises:
(a) the VH comprising an amino acid sequence with at least 75% sequence identity to SEQ ID NO: 7351 or SEQ ID NO: 253; and
(b) the VL comprising an amino acid sequence with at least 75% sequence identity to SEQ ID NO: 258.

6. The multifunctional molecule of claim 1, wherein the first antigen binding domain comprises:
(a) the VH comprising an amino acid sequence with at least 75% sequence identity to SEQ ID NO: 7351 and the VL comprising an amino acid sequence with at least 75% sequence identity to SEQ ID NO: 258;
(b) the VH comprising an amino acid sequence with at least 75% sequence identity to SEQ ID NO: 250 and the VL comprising an amino acid sequence with at least 75% sequence identity to SEQ ID NO: 255;
(c) the VH comprising an amino acid sequence with at least 75% sequence identity to SEQ ID NO: 251 and a VL comprising an amino acid sequence with at least 75% sequence identity to SEQ ID NO: 256;
(d) the VH comprising an amino acid sequence with at least 75% sequence identity to SEQ ID NO: 252 and the VL comprising an amino acid sequence with at least 75% sequence identity to SEQ ID NO: 257;
(e) the VH comprising an amino acid sequence with at least 75% sequence identity to SEQ ID NO: 253 and the VL comprising an amino acid sequence with at least 75% sequence identity to SEQ ID NO: 258;
(f) the VH comprising an amino acid sequence with at least 75% sequence identity to SEQ ID NO: 254 and the VL comprising an amino acid sequence with at least 75% sequence identity to SEQ ID NO: 259;

(g) the VH comprising an amino acid sequence with at least 75% sequence identity to SEQ ID NO: 7343 and the VL comprising an amino acid sequence with at least 75% sequence identity to SEQ ID NO: 260;
(h) the VH comprising an amino acid sequence with at least 75% sequence identity to SEQ ID NO: 7344 and the VL comprising an amino acid sequence with at least 75% sequence identity to SEQ ID NO: 7357;
(i) the VH comprising an amino acid sequence with at least 75% sequence identity to SEQ ID NO: 7350 and the VL comprising an amino acid sequence with at least 75% sequence identity to SEQ ID NO: 7358;
(j) the VH comprising an amino acid sequence with at least 75% sequence identity to SEQ ID NO: 7351 and the VL comprising an amino acid sequence with at least 75% sequence identity to SEQ ID NO: 7359; or
(k) the VH comprising an amino acid sequence with at least 75% sequence identity to SEQ ID NO: 7352 and the VL comprising an amino acid sequence with at least 75% sequence identity to SEQ ID NO:7360.

7. The multifunctional molecule of claim 1, wherein the first antigen binding domain comprises:
(a) a heavy chain comprising an amino acid sequence with at least 75% sequence identity to SEQ ID NO: 7382 or SEQ ID NO: 7379;
(b) a light chain comprising an amino acid sequence with at least 75% sequence identity to SEQ ID NOs: 7380; or
(c) any combination thereof.

8. The multifunctional molecule of claim 1, wherein the first antigen binding domain has a higher affinity for a T cell receptor comprising TRBC1 than for a T cell receptor comprising TRBC2.

9. The multifunctional molecule of claim 1, wherein the second antigen binding domain comprises:
(a) the VH comprising:
(i) the VHCDR1 amino acid sequence of SEQ ID NO: 7313,
(ii) the VHCDR2 amino acid sequence of SEQ ID NO: 6001, and
(iii) the VHCDR3 amino acid sequence of SEQ ID NO: 7315; and
(b) the VL comprising:
(i) the VLCDR1 amino acid sequence of SEQ ID NO: 7326,
(ii) the VLCDR2 amino acid sequence of SEQ ID NO: 7327, and
(iii) the VLCDR3 amino acid sequence of SEQ ID NO: 7329.

10. The multifunctional molecule of claim 1, wherein the second antigen binding domain comprises:
(a) the VH comprising an amino acid sequence with at least 75% sequence identity to any one of SEQ ID NOs: 6121-6134, 7295, 7297, 7298, and 7300-7304; and
(b) the VL comprising an amino acid sequence with at least 75% sequence identity to any one of SEQ ID NOs: 6136-6147, 7294, 7296, 7299, and 7305-7309.

11. The multifunctional molecule of claim 9, wherein the second antigen binding domain comprises:
(a) the VH comprising an amino acid sequence with at least 75% sequence identity to SEQ ID NO: 7302; and
(b) the VL comprising an amino acid sequence with at least 75% sequence identity to SEQ ID NO: 7309.

12. The multifunctional molecule of claim 4, wherein the second antigen binding domain comprises:
(a) the VH comprising an amino acid sequence with at least 75% sequence identity to SEQ ID NO: 7302 and the VL comprising an amino acid sequence with at least 75% sequence identity to SEQ ID NO: 7309;
(b) the VH comprising an amino acid sequence with at least 75% sequence identity to SEQ ID NO: 6121 and the VL comprising an amino acid sequence with at least 75% sequence identity to SEQ ID NO: 7294;
(c) the VH comprising an amino acid sequence with at least 75% sequence identity to SEQ ID NO: 6122 and the VL comprising an amino acid sequence with at least 75% sequence identity to SEQ ID NO: 6136;
(d) the VH comprising an amino acid sequence with at least 75% sequence identity to SEQ ID NO: 6123 and the a VL comprising an amino acid sequence with at least 75% sequence identity to SEQ ID NO: 6137;
(e) the VH comprising an amino acid sequence with at least 75% sequence identity to SEQ ID NO: 6124 and the VL comprising an amino acid sequence with at least 75% sequence identity to SEQ ID NO: 6138;
(f) the VH comprising an amino acid sequence with at least 75% sequence identity to SEQ ID NO: 6125 and the VL comprising an amino acid sequence with at least 75% sequence identity to SEQ ID NO: 6139;
(g) the VH comprising an amino acid sequence with at least 75% sequence identity to SEQ ID NO: 6126 and the VL comprising an amino acid sequence with at least 75% sequence identity to SEQ ID NO: 6140;
(h) the VH comprising an amino acid sequence with at least 75% sequence identity to SEQ ID NO: 6127 and the VL comprising an amino acid sequence with at least 75% sequence identity to SEQ ID NO: 6141;
(i) the VH comprising an amino acid sequence with at least 75% sequence identity to SEQ ID NO: 6129 and the VL comprising an amino acid sequence with at least 75% sequence identity to SEQ ID NO: 6142;
(j) the VH comprising an amino acid sequence with at least 75% sequence identity to SEQ ID NO: 6130 and the VL comprising an amino acid sequence with at least 75% sequence identity to SEQ ID NO: 6143;
(k) the VH comprising an amino acid sequence with at least 75% sequence identity to SEQ ID NO: 6131 and the VL comprising an amino acid sequence with at least 75% sequence identity to SEQ ID NO: 6144;
(l) the VH comprising an amino acid sequence with at least 75% sequence identity to SEQ ID NO: 6132 and the VL comprising an amino acid sequence with at least 75% sequence identity to SEQ ID NO: 6145;
(m) the VH comprising an amino acid sequence with at least 75% sequence identity to SEQ ID NO: 6133 and the VL comprising an amino acid sequence with at least 75% sequence identity to SEQ ID NO: 6146;
(n) the VH comprising an amino acid sequence with at least 75% sequence identity to SEQ ID NO: 6134 and the VL comprising an amino acid sequence with at least 75% sequence identity to SEQ ID NO: 6147;
(o) the VH comprising an amino acid sequence with at least 75% sequence identity to SEQ ID NO: 7295 and the VL comprising an amino acid sequence with at least 75% sequence identity to SEQ ID NO: 7296;
(p) the VH comprising an amino acid sequence with at least 75% sequence identity to SEQ ID NO: 7298 and the VL comprising an amino acid sequence with at least 75% sequence identity to SEQ ID NO: 7299;
(q) the VH comprising an amino acid sequence with at least 75% sequence identity to SEQ ID NO: 7300 and the VL comprising an amino acid sequence with at least 75% sequence identity to SEQ ID NO: 7305;

(r) the VH comprising an amino acid sequence with at least 75% sequence identity to SEQ ID NO: 7301 and the VL comprising an amino acid sequence with at least 75% sequence identity to SEQ ID NO: 7306;
(s) the VH comprising an amino acid sequence with at least 75% sequence identity to SEQ ID NO: 7302 and the VL comprising an amino acid sequence with at least 75% sequence identity to SEQ ID NO: 7307;
(t) the VH comprising an amino acid sequence with at least 75% sequence identity to SEQ ID NO: 7303 and the VL comprising an amino acid sequence with at least 75% sequence identity to SEQ ID NO: 7308; or
(u) the VH comprising an amino acid sequence with at least 75% sequence identity to SEQ ID NO: 7304 and the VL comprising an amino acid sequence with at least 75% sequence identity to SEQ ID NO: 7309.

13. The multifunctional molecule of claim 1, wherein the second antigen binding domain comprises an amino acid sequence with at least 85% sequence identity to SEQ ID NO: 7383.

14. The multifunctional molecule of claim 1, wherein the multifunctional molecule further comprises a cytokine molecule.

15. The multifunctional molecule of claim 14, wherein the cytokine molecule is interleukin-2 (IL-2), interleukin-7 (IL-7), interleukin-12 (IL-12), interleukin-15 (IL-15), interleukin-18 (IL-18), interleukin-21 (IL-21), or interferon gamma.

16. The multifunctional molecule of claim 1, wherein the multifunctional molecule further comprises a TGF-beta inhibitor.

17. The multifunctional molecule of claim 16, wherein the TGF-beta inhibitor comprises the extracellular domain of a TGF-beta receptor.

18. The multifunctional molecule of claim 1, comprising:
(a) the first antigen binding domain that comprises the VH and the VL of claim 2,
(b) the second antigen binding domain that comprises the VH and the VL of claim 9, and
(c) a cytokine molecule that is IL-2.

19. The multifunctional molecule of claim 18, wherein the multifunctional molecule comprises an immunoglobulin constant domain.

20. A pharmaceutical composition comprising the multifunctional molecule of claim 1; and a pharmaceutically acceptable carrier, excipient, or stabilizer.

21. A polynucleotide comprising a sequence encoding the multifunctional molecule of claim 1.

22. A host cell comprising the polynucleotide of claim 21.

23. A method of making the multifunctional molecule of claim 1, comprising culturing the host cell of claim 22 under suitable conditions for gene expression and/or homo- or heterodimerization.

* * * * *